US007364864B2

(12) United States Patent (10) Patent No.: US 7,364,864 B2
Zhang et al. (45) Date of Patent: Apr. 29, 2008

(54) ANGE GENE IN ATOPY

(75) Inventors: Youming Zhang, Oxford (GB);
Miriam Moffatt, Bicester (GB);
William Cookson, Oxford (GB); Jon Tinsley, Didcot (GB)

(73) Assignee: Isis Innovation Limited, Oxford (GB)

( * ) Notice: Subject to any disclaimer, the term of this patent is extended or adjusted under 35 U.S.C. 154(b) by 0 days.

(21) Appl. No.: 11/266,699

(22) Filed: Nov. 3, 2005

(65) Prior Publication Data

US 2006/0257928 A1 Nov. 16, 2006

Related U.S. Application Data

(63) Continuation of application No. 10/481,613, filed as application No. PCT/GB02/02859 on Jun. 21, 2002, now abandoned.

(30) Foreign Application Priority Data

Jun. 21, 2001 (GB) ................. 0115211.5
Jun. 21, 2001 (GB) ................. 0115212.3
Jun. 21, 2001 (GB) ................. 0115213.1

(51) Int. Cl.
*G01N 33/53* (2006.01)
*C07K 14/00* (2006.01)

(52) U.S. Cl. ....................... 435/7.1; 530/350
(58) Field of Classification Search ................ 435/7.1; 530/350
See application file for complete search history.

(56) References Cited

U.S. PATENT DOCUMENTS 6,979,549 B2 * 12/2005 Masuda et al. ............ 435/7.21

FOREIGN PATENT DOCUMENTS

| CN | 1 329 029 | 1/2002 |
|---|---|---|
| CN | 1 376 679 | 10/2002 |
| WO | WO 97/33909 | 9/1997 |
| WO | WO 99/04265 | 1/1999 |
| WO | WO 99/18210 | 4/1999 |
| WO | WO 99/38973 | 8/1999 |
| WO | WO 00/58473 | 10/2000 |
| WO | WO 00/60077 | 10/2000 |
| WO | WO 01/60860 | 8/2001 |
| WO | WO 01/70979 | 9/2001 |
| WO | WO 01/79556 | 10/2001 |
| WO | WO 02/068579 | 9/2002 |
| WO | WO 02/079404 | 10/2002 |
| WO | WO 03/052048 | 6/2003 |
| WO | WO 2004/007671 A2 | 1/2004 |

OTHER PUBLICATIONS

Cory et al. 1974; Inhibitors of Histone Methylation. Chem.-Biol. Interactions 9: 253-259.*

Mabuchi et al.(Apr. 1, 2001. Cloning and characterization of CLLD6, CLLD7, and CLLD8, novel candidate genes for leukemogenesis at chromosome 13q14, a region commonly deleted in B-cell chronic lymphatic leukemia. Cancer Research 61:2870-2877.*
Lee et al. 1977; Phosphorylation and methylation of chromatin proteins from mouse brain nuclei. J. Neurocheminstry 29: 547-550.*
Wallwork et al.1978; A sensitive assay for histone methyltransferase. Analytical Biochemistry 84: 103-110.*
Vandel et al. 2001 ; Physcial assoication between the histone acetyl transferase CBP and a histone methyl transferase. EMBO Reports. 2(1): 21-26.*
Database EMBL Online, Jan. 7, 2000, Database accession No. AB011031.
Database EMBL Online, Sep. 29, 2000, Database accession No. AK026228.
Reference SNP Cluster Report, Online, Jan. 29, 2001, rs1046295, Retrieved from the Internet.
Database EMBL Online, Mar. 1, 2001, Database accession No. AL139321.
Database EMBL Online, Mar. 4, 2000, Database accession No. H83343.
Database EMBL Online, Feb. 6, 2000, Database accession No. AW387566.
Bhattacharyya et al., "A High-Density Genetic Map of the Chromosome 13q14 Atopy Locus," *Genomics* 70:286-291 (2000).
Mabuchi et al., "Cloning and Characterization of CLLD6, CLLD7, and CLLD8, Novel Candidate Genes for Leukemogenesis at Chromosome 13q14, a Region Commonly Deleted in B-Cell Chronic Lymphocytic Leukemia," *Cancer Research* 61:2870-2877 (2001).
Palmer et al., "Using single nucleotide polymorphisms as a means to understanding the pathophysiology of asthma," *Respir. Res.* 2:102-112 (2001).
Scanlan et al., "Antigens Recognized by Autologous Antibody in Patients With Renal-Cell Carcinoma," *Int. J. Cancer* 83:456-464 (1999).
Aasland et al., "The PHD finger: Implications for chromatin-mediated transcriptional regulation," *TIBS*, 1995, 20:56-59.

(Continued)

*Primary Examiner*—Karen Cochrane Carlson
(74) *Attorney, Agent, or Firm*—Fish & Richardson P.C.

(57) ABSTRACT

The present invention relates to isolated nucleic acid sequences of ANGE, CLLD8 and CLLD7 or sequences complementary or substantially homologous thereto or fragments thereof. Also provided are sequences comprising hybrid nucleic acid sequences from two or more of the genes. Also provided are nucleic acid expression vectors, polypeptides, antibodies to the polypeptides, host cells, non-human transgenic animals and pharmaceutical compositions and agents. Also provided is the use of the nucleic acid sequence and/or protein in medicine and research, methods for diagnosing or determining predisposition to disease or severity of disease, methods for preventing or treating disease, and kits for use in the methods and the use of the nucleic acid sequence and protein in treating or preventing IgE mediated diseases and non-atopic asthma, and in screens for identifying new agents for use in the methods.

22 Claims, 338 Drawing Sheets

OTHER PUBLICATIONS

Abecasis et al., "A General Test of Association for Quantitative Traits in Nuclear Families," *Am. J. Hum. Genet.*, 2000, 66:279-292.

Abecasis and Cookson, "GOLD-Graphical Overview of Linking Disequilibrium," *Bioinformatics*, 2000, 16(2):182-183.

Abecasis et al., "Merlin-rapid analysis of dense genetic maps using sparse gene flow trees," *Nature Genetics*, 2002, 30:97-101.

Abecasis et al., "The Power to Detect Linkage Disequilibrium with Quantitative Traits in Selected Samples," *Am. J. Hum. Genet.*, 2001, 68:1463-1474.

Abecasis et al., "Extent and Distribution of Linkage Disequilibrium in Three Genomic Regions," *Am. J. Hum. Genet.*, 2001, 68:191-197.

Altschul et al., "Gapped Blast and PSI-Blast: a new generation of protein database search programs," *Nucl. Acids Res.*, 1997, 25(17):3389-3402.

Anderson et al., "Positive association to IgE levels and a physical map of the 13q14 atopy locus," *Eur. J. Hum. Genet.*, 2002, 10:266-270.

Angioni et al., "Interstitial Insertion of *AF10* into the *ALL1* Gene in a Case of Infant Acute Lymphoblastic Leukemia," *Cancer Genet. Cytogenet.*, 1998, 107:107-110.

Bentley et al., "The physical maps for sequencing human chromosomes 1, 6, 9, 10, 13, 20 and x," *Nature*, 2001, 409:942-943.

Beyer et al., "Evidence for Linkage of Chromosome 5q31-q33 and 13q12-q14 Markers to Atopic Dermatitis," *J. Allergy Clin. Immunol.*, 1998, p. S152, Abstract No. 631.

Bhattacharyya et al., "A High-Density Genetic Map of the Chromosome 13q14 Atopy Locus," *Genomics*, 2000, 70:286-291.

Burge and Karlin, "Prediction of Complete Gene Structures in Human Genomic DNA," *J. Mol. Biol.*, 1997, 268:78-94.

Chesi et al., "The t(4;14) Translocation in Myeloma Dysregulates Both *FGFR3* and a Novel Gene, *MMSET*, Resulting in IgH/MMSET Hybrid Transcripts," *Blood*, 1998, 92(9):3025-3034.

Cookson and Palmer, "Investigating the asthma phenotype," *Clin. Exp. Allergy*, 1998, 28(Suppl. 1):88-89.

Cookson, "The alliance of genes and environment in asthma and allergy," *Nature*, 1999, 402(Supp):B5-B11.

Cox et al., "Association of atopic dermatitis to the beta subunit of the high affinity immunoglobulin E receptor," *Br. J. Dermatol.*, 1998, 138:182-187.

Daniels et al., "A genome-wide search for quantitative trait loci underlying asthma," *Nature*, 1996, 383:247-250.

Dizier et al., "Detection of a Recessive Major Gene for High IgE Levels Acting Independently of Specific Response to Allergens," *Genetic Epidemiology*, 1995, 12:93-105.

Duffy et al., "Genetics of Asthma and Hay Fever in Australian Twins," *Am. Rev. Respir. Dis.*, 1990, 142:1351-1358.

Eiberg et al., "Linkage relationship between the human immunoglobulin-E polymorphism and marker systems," *Cytogenetics and Cell Genetics*, 1985, 42:622, Abstract.

Fair et al., "Protein Interactions of the MLL PHD Fingers Modulate MLL Target Gene Regulation in Human Cells," *Mol. Cell. Biol.*, 2001, 21(10):3589-3597.

Flint et al., "Comparative genome analysis delimits a chromosomal domain and identifies key regulatory elements in the $\alpha$ globin cluster," *Hum. Mol. Genet.*, 2001, 10(4):371-382.

Garlisi et al., "A Unique mRNA Initiated within a Middle Intron of *WHSC1/MMSET* Encodes a DNA Binding Protein That Suppresses Human *IL-5* Transcription," *Am. J. Respir. Cell Mol. Biol.*, 2001, 24:90-98.

Gerrard et al., "A Genetic Study of Immunoglobulin E," *Am. J. Hum. Genet.*, 1978, 30:46-58.

Hill et al., "*FceRl-β* polymorphism and risk of atopy in a general population sample," *BMJ*, 1995, 311:776-779.

Hizawa et al., "Genetic regulation of *Dermatophagoides pteronyssinus*-specific IgE responsiveness: A genome-wide multipoint linkage analysis in families recruited through 2 asthmatic sibs," *J. Allergy Clin. Immunol.*, 1998, 102:436-442.

Jarvis and Burney, "The epidemiology of allergic disease," *BMJ*, 1998, 316:607-610.

Jenuwein, "Re-SET-ting heterochromatin by histone methyltransferases," *Trends Cell Biol.* 2001, 11(6):266-273.

Jurka, "Repbase Update. a database and an electronic journal of repetitive elements," *TIG*, 2000, 16(9):418-420.

Kalachikov et al., "Cloning and Gene Mapping of the Chromosome 13q14 Region Deleted in Chronic Lymphocytic Leukemia," *Genomics*, 1997, 42:369-377.

Kimura et al., "Linkage and association of atopic asthma to markers on chromosome 13 in the Japanese population," *Hum. Mol. Genet.*, 1999, 8(8):1487-1490.

Lander et al., "Initial sequencing and analysis of the human genome," *Nature*, 2001, 409:860-921.

Larsen et al., "CpG Islands as Gene Markers in the Human Genome," *Genomics*, 1992, 13:1095-1107.

Lavender et al., "Presentation at the National Asthma Campaign International Congress, Jun. 1999. Controlling the imflammatory response through transcriptional mechanisms," *Clin. Exp. Allergy*, 2000, 30:1697-1708.

Linder et al., "Biochemical Analyses of the AF10 Protein: The Extended LAP/PHD-finger Mediates Oligomerisation," *J. Mol. Biol.*, 2000, 299:369-378.

McPherson et al., "A physical map of the human genome," *Nature*, 2001, 409:934-941.

Miyake et al., "A Functional Comparison of BRCA1 C-terminal Domains in Transcription Activation and Chromatin Remodeling," *J. Biol. Chem.*, 200, 275(51):40169-40173.

Monks et al., "A Comparative Study of Sibship Tests of Linkage and/or Association," *Am. J. Hum. Genet.*, 1998, 63:1507-1516.

Nakayama et al., "Role of Histone H3 Lysine 9 Methylation in Epigenetic Control of Heterochromatin Assembly," *Science*, 2001, 292:110-113.

Nemergut et al., "Chromatin Docking and Exchange Activity Enhancement of RCC1 by Histones H2A and H2B," *Science*, 2001, 292:1540-1543.

Ober et al., "Genome-wide search for asthma susceptibility loci in a founder population," *Hum. Mol. Genet.*, 1998, 7(9):1393-1398.

O'Connor and Weiss, "Clinical and Symptom Measures," *Am. J. Respir. Crit. Care Med.*, 1994, 149:S21-S28.

Ohki et al., "Solution Structure of the Methyl-CpG Binding Domain of Human MBD1 in Complex with Methylated DNA," *Cell*, 2001, 105:487-497.

Oscier, "Cytogenetic and Molecular Abnormalities in Chronic Lymphocytic Leukaemia," *Blood Reviews*, 1994, 8:88-97.

Osoegawa et al., "A Bacterial Artificial Chromosome Library for Sequencing the Complete Human Genome," *Genome Research*, 2001, 11:483-496.

Palmer et al., "Independent Inheritance of Serum Immunoglobulin E Concentrations and Airway Responsiveness," *Am. J. Respir. Crit. Care Med.*, 2000, 161:1836-1843.

Prestridge, "Predicting Pol II Promoter Sequences using Transcription Factor Binding Sites," *J. Mol. Biol.*, 1995, 249:923-932.

Rea et al., "Regulation of chromatin structure by site-specific Histone H3 methyltransferases," *Nature*, 2000, 406:593-599.

Risch and Zhang, "Mapping Quantitative Trait Loci with Extreme Discordant Sib Pairs; Sampling Considerations," *Am. J. Hum. Genet.*, 1996, 58:836-843.

Scanlan et al., "Antigens Recognized by Autologous Antibody in Patients with Renal-Cell Carcinoma," *Int. J. Cancer*, 1999, 83:456-464.

Schultz et al., "SMART: a web-based tool for the study of genetically mobile domains," *Nucl. Acids Res.*, 2000, 28(1):231-234.

Snyder and Stormo, "Identification of coding regions in genomic DNA sequences: an application of dynamic programming and neural networks," *Nucl. Acids Res.*, 1993, 21(3):607-613.

Takeda et al., "Isolation and mapping of karyopherin α3 (KPNA3), a human gene that is highly homologous to genes encoding *Xenopus* importin, yeast SRP1 and human RCH1," *Cytogenet. Cell Genet.*, 1997, 76:87-93.

Terwilliger and Weiss, "Linkage disequilibrium mapping of complex disease: fantasy or reality?" *Curr. Opin. Biotech.*, 1998, 9:578-594.

Wakefield et al., "The Solution Structure of the Domain from MeCP2 that Binds to Methylated DNA," *J. Mol. Biol.*, 1999, 291:1055-1065.

Walker et al., "Alternative Exon Splicing Controls a Translational Switch from Activator to Repressor Isoforms of Transcription Factor CREB during Spermatogenesis," *J. Biol. Chem.*, 1996, 271(33):20145-20150.

Xu et al., "Constructing gene models from accurately predicted exons: an application of dynamic programming," *CABIOS*, 1994, 10(6):613-623.

Zhang, "Identification of protein coding regions in the human genome by quadratic discriminant analysis," *Proc. Natl. Acad. Sci. USA*, 1997, 94:565-568.

Jang N. et al., "Polymorphisms within the PHF11 gene at chromosome 13q14 are associated with the childhood atopic dermatitis," *Gene and Immunity*, vol. 6(3):1-3 (2005).

GenBank Accession No. AF155105 dated Jan. 6, 2000, 2 pages.

* cited by examiner

FIG. 1
a) Linkage disequilibrium map of the Atopy locus
The size bar indicates a region of 200Kb
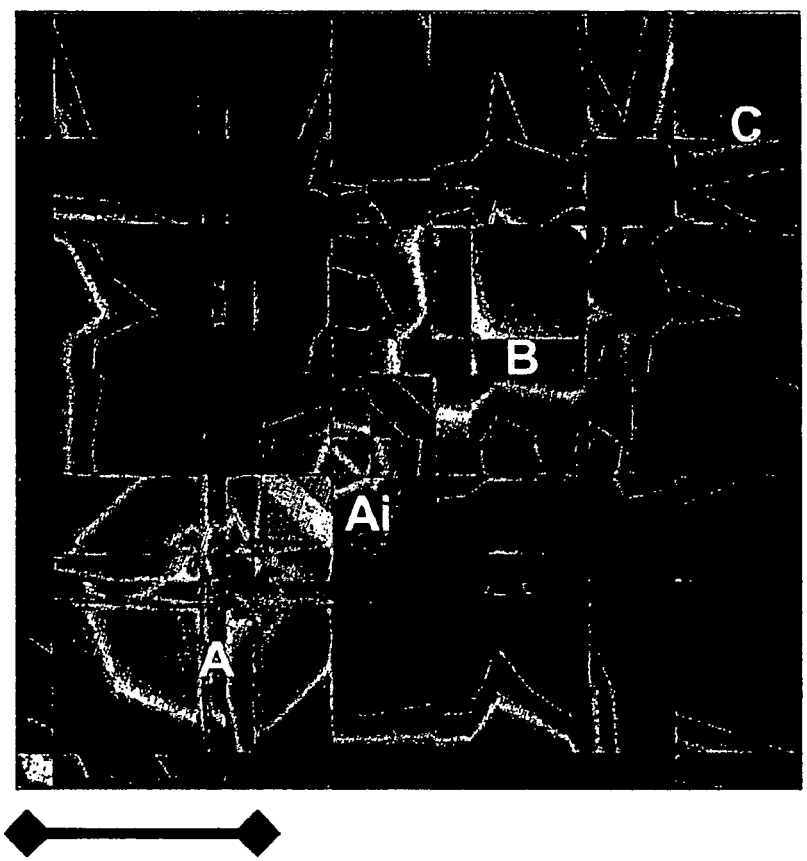
b) Detail of LD around the ANGE (NY-REN-34) gene complex
The size bar indicates a region of 100Kb
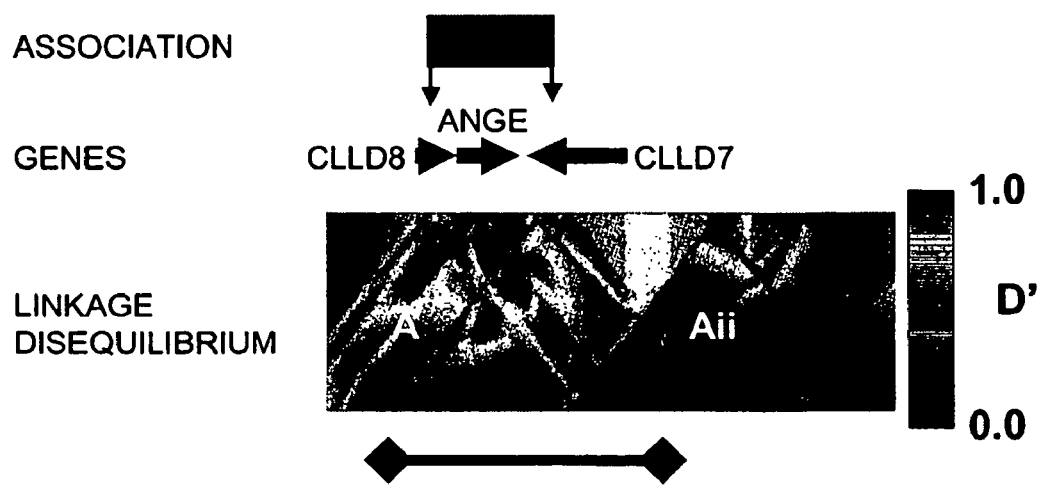

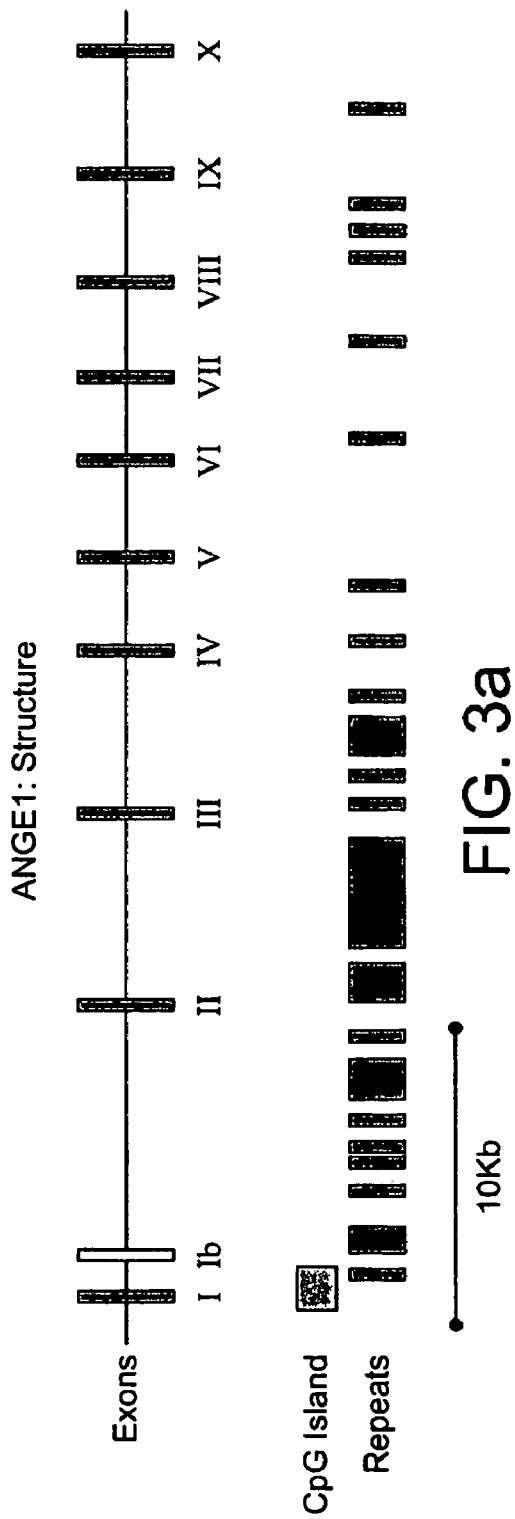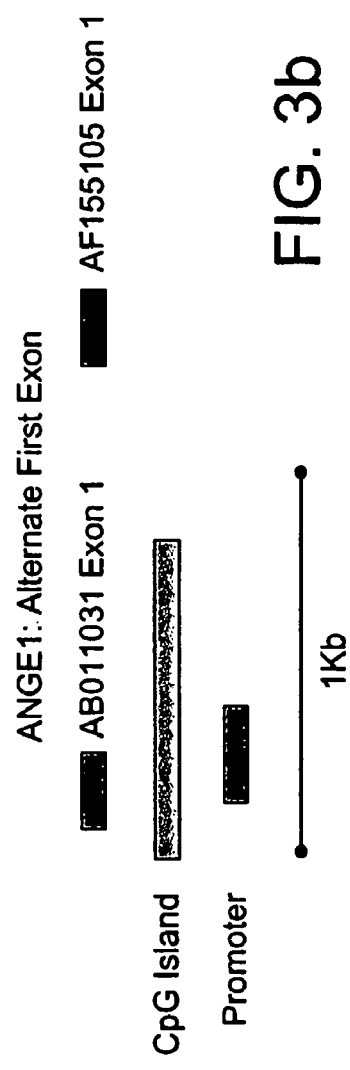

Pile up of transcripts cloned by amplification between alternative exon I and exon III of ANGE. PCR primers mark the L and R extent of each transcript (so it can be seen that either of two primers were used for alternative exon I, whereas the same primer was always used for exon III). Multiple versions of alternative exon I are discernable, and skipping of exon II is observed in some transcripts. Variation is also observed in the length of exon II.

| FIG. 3C/1 | FIG. 3C/2 |
|---|---|
| FIG. 3C/3 | FIG. 3C/4 |

Alternative Exon I (begin)

```
139321_1_30000.seq.chopped/1  ----------TCATGGCCCAGGCGTCGCCGCCCCCGGCCCGAGAGGGTGCTCGGGCGCAGCAGCCC
          form_1/1-575        ----------------------------------------------------------------
          from_2/1-575        ----------------------------------------------------------------
          Clone_B/1-575       ----------------------------------------------------------------
          Clone_C/1-575       ----------------------------------------------------------------
          Clone_D/1-575       ----------------------------------------------------------------
          Clone_E/1-575       ----------------------------------------------------------------
          Clone_F/1-575       ----------------------------------------------------------------
          Clone_G/1-575       ----------------------------------------------------------------
          Clone_H/1-575       ----------------------------------------------------------------
          Clone_I/1-575       ----------------------------------------------------------------
          Clone_J/1-575       ----------------------------------------------------------------
          Clone_1/1-575       ---TCATGGCCCAGGCGTCGCCGCCGCCCCGGTCCGGAGGGGTGCTCGGGCGCAGCAGCCC
          Clone_2/1-575       ---TCATGGCCCAGGCGTCGCCGCCGCCCCGGCCCGGAGGGGTGCTCGGGCGCGGCAGCCC
          Clone_2a/1-575      ---TATGGCCCAGGCGTCGCCGCCCCGGCCCG--------------------------------
                ruler  0........50........60........70........80........90........100...
```

Alternative Exon I (middle)

```
139321_1_30000.seq.chopped/1  CGGTAAACCAGGACAGTGGAGGGCGCCCTGATGCGGTGGGCAAGACTCAGCCAAAGGTGGAAA
          form_1/1-575        CGGTAAACCAGGACAGTGGAGGGCGCCCTGATGCGGTGGGCAAGACTCAGCCAAAGGTGGAAA
          from_2/1-575        CGGT------------------------------------------------------------
          Clone_B/1-575       CGGTAAACCAGGACAGTGGAGGGCGCCCTGATGCGGT---------------------------
          Clone_C/1-575       CGGTAAACCAGGACAGTGGAGGGCGCCCTGATGCGGT---------------------------
          Clone_D/1-575       CGGTAAACCAGGACAGTGGAGGGCGCCCTGATGCGGT---------------------------
          Clone_E/1-575       CGGTAAACCAGGACAGTGGAGGGCGCCCTGATGCGG----GCAAGACTCAGCCAAAGGTGGAAA
          Clone_F/1-575       CGGTAAACCAGGACAGTGGAGGGCGCCCTGATGCGG----GCAAGACTCAGCCAAAGGTGGAAA
          Clone_G/1-575       CGGTAAACCAGGACAGTGGAGGGCGCCCTGATGCGG----GCAAGACTCAGCCAAAGGTGGAAA
          Clone_H/1-575       CGGTAAACCAGGACAGTGGAGGGCGCCCTGATGCGG----GCAAGACTCAGCCAAAGGTGGAAA
          Clone_I/1-575       CGGTAAACCAGGACAGTGGAGGGCGCCCTGATGC------------------------------
          Clone_J/1-575       CGG-------------------------------------------------------------
          Clone_1/1-575       C---------------------------------------------------------------
          Clone_2/1-575       ----------------------------------------------------------------
          Clone_2a/1-575      ----------------------------------------------------------------
                ruler  0........200.......210.......220.......230.......240.......250...
```

FIG. 3C/2

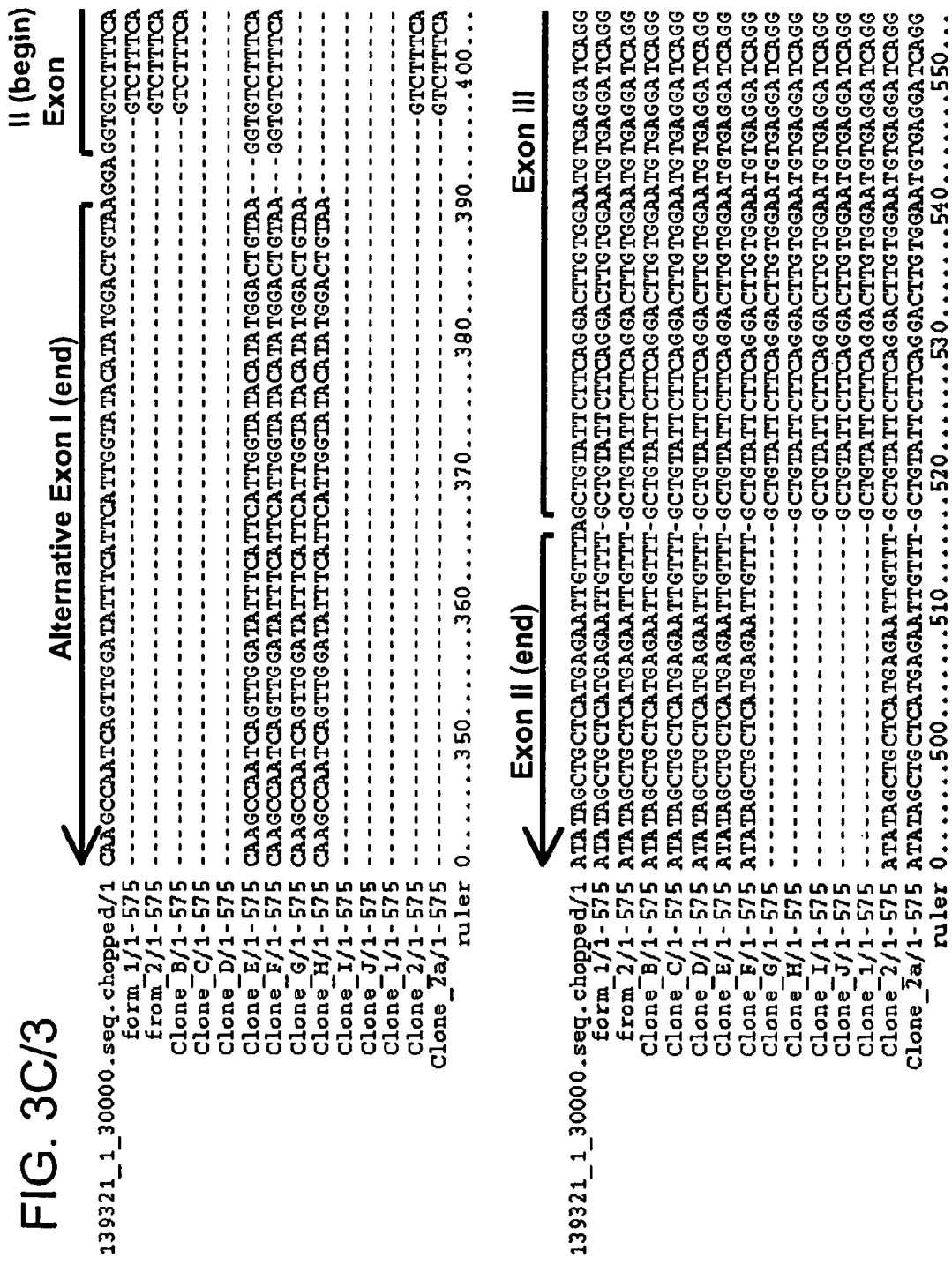
FIG. 3C/3

FIG. 3C/4

```
                                                                    II (begin) Exon
                                                                    ─────────────▶
GGTTGCAGAAAAGATGGAAAAAAGGACATGTGCACTCTGCCCCAAAGATGTCGAATATAATGTCCTATACTTTGCACAATCAGAGA    441
GGTTGCAGAAAAGATGGAAAAAAGGACATGTGCACTCTGCCCCAAAGATGTCGAATATAATGTCCTATACTTTGCACAATCAGAGA    173
GGTTGCAGAAAAGATGGAAAAA-GGACATGTGCACTCTGCCCCAAAGATGTCGAATATAATGTCCTATACTTTGCACAATCAGAGA    174
GGTTGCAGAAAAGATGGAAAAAAGGACATGTGCACTCTGCCCCAAAGATGTCGAATATAATGTCCTATACTTTGCACAATCAGAGA    140
---TGCAGAAAAGATGGAAAAAAGGACATGTGCACTCTGCCCCAAAGATGTCGAATATAATGTCCTATACTTTGCACAATCAGAGA    163
---TGCAGAAAAGATGGAAAAAAGGACATGTGCACTCTGCCCCAAAGATGTCGAATATAATGTCCTATACTTTGCACAATCAGAGA    129
GGTTGCAGAAAAGATGGAAAAAAGGACATGTGCACTCTGCCCCAAAGATGTCGAATATAATGTCCTATACTTTGCACAATCAGAGA    336
GGTTGCAGAAAAGATGGAAAAAAGGACATGTGCACTCTGCCCCAAAGATGTCGAATATAATGTCCTATACTTTGCACAATCAGAGA    302
                                                                                         239
                                                                                         205
                                                                                          77
                                                                                          43
                                                                                          94
.GGTTGCAGAAAAGATGGAAAAAAAAGGACATGTGCACTCTGCCCCAAAGATGTCGAATATAATGTCCTATACTTTGCACAATCAGAGA   192
GGTTGCAGAAAAGATGGAAAAAAGGACATGTGCACTCTGCCCCAAAGATGTCGAATATAATGTCCTATACTTTGCACAATCAGAGA    157
...410........420........430........440........450........460........470........480......49

Exon III
                                 ┌─────
ATCCACTTAATCCTTGATGAAGTTTTGATGTGGAATCAGTAAAGAAAGAAATCCAGAGAGGAAGGAAGT─                      574
ATCCACTTAATCCTTGATGAAGTTTTGATGTGGAATCAGTAAAGAAAGAAATCCAGAGAGGAAGGAAGTT                      306
ATCCACTTAATCCTTGATGAAGTTTTGATGTGGAATCAGTAAAGAAAGAAATCCAGAGAGGAAGGAAGTT                      307
ATCCACTTAATCCTTGATGAAGTTTTGATGTGGAATCAGTAAAGAAAGAAATCCAGAGAGGAAGGAAGTT                      273
ATCCACTTAATCCTTGATGAAGTTTTGATGTGGAATCAGTAAAGAAAGAAATCCAGAGAGGAAGGAAGTT                      296
ATCCACTTAATCCTTGATGAAGTTTTGATGTGGAATCAGTAAAGAAAGAAATCCAGAGAGGAAGGAAGTT                      262
ATCCACTTAATCCTTGATGAAGTTTTGATGTGGAATCAGTAAAGAAAGAAATCCAGAGAGGAAGGAAGTT                      469
ATCCACTTAATCCTTGATGAAGTTTTGATGTGGAATCAGTAAAGAAAGAAATCCAGAGAGGAAGGAAGTT                      435
ATCCACTTAATCCTTGATGAAGTTTTGATGTGGAATCAGTAAAGAAAGAAATCCAGAGAGGAAGGAAGTT                      347
ATCCACTTAATCCTTGATGAAGTTTTGATGTGGAATCAGTAAAGAAAGAAATCCAGAGAGGAAGGAAGTT                      313
ATCCACTTAATCCTTGATGAAGTTTTGATGTGGAATCAGTAAAGAAAGAAATCCAGAGAGGAAGGAAGTT                      185
ATCCACTTAATCCTTGATGAAGTTTTGATGTGGAATCAGTAAAGAAAGAAATCCAGAGAGGAAGGAAGTT                      151
ATCCACTTAATCCTTGATGAAGTTTTGATGTGGAATCAGTAAAGAAAGAAATCCAGAGAGGAAGGAAGTT                      202
ATCCACTTAATCCTTGATGAAGTTTTGATGTGGAATCAGTAAAGAAAGAAANAAATCCAGAGAGGAAGGAAGTT                   325
ATCCACTTAATCCTTGATGAAGTTTTGATGTGGAATCAGTAAAGAAAAAATCCAGAGAGGAAGGAAGTT                       290
...560........570........580........590........600........610........620........630......64
```

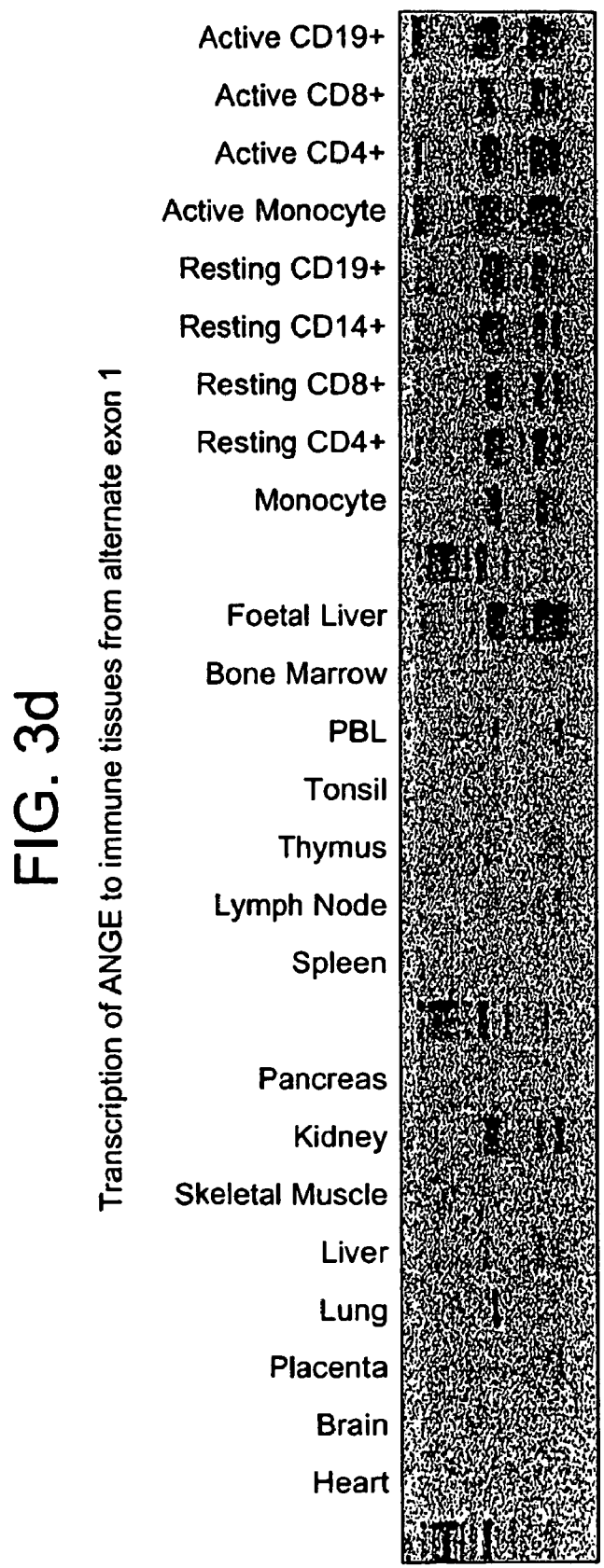

FIG. 4
Splice variation in ANGE in multiple tissue cDNA panels
a) PCR amplifications of exons 1-3
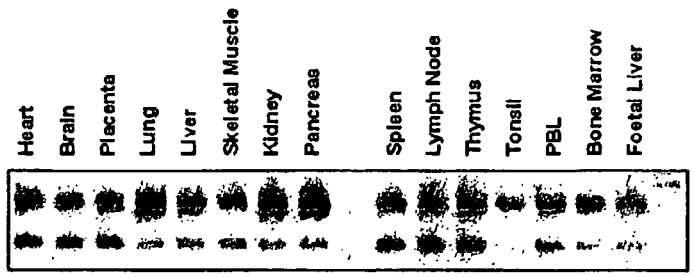
b) PCR amplification of exon 4-6
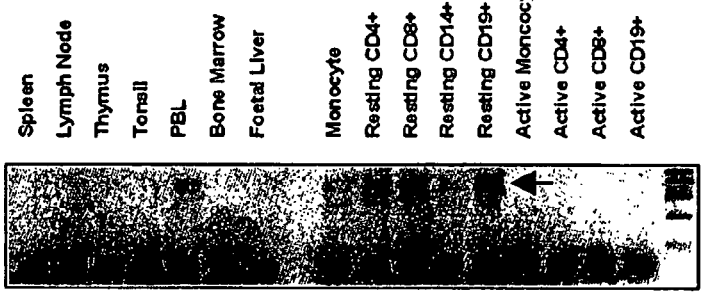
Exon structure of alternatively spliced band
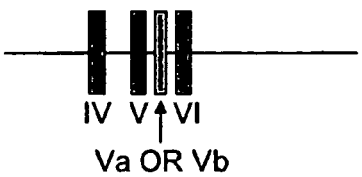
IV V VI
Va OR Vb
c) PCR amplification of exon 7-8
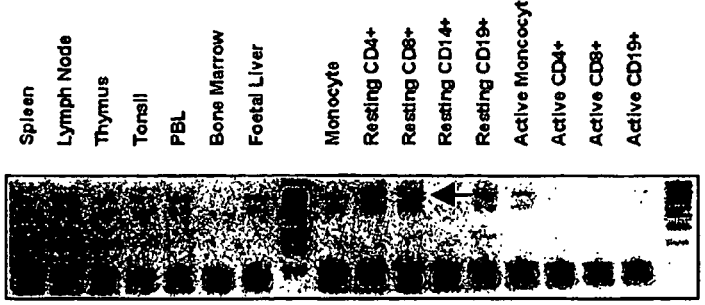

FIG. 5 bA103j18.03548

```
   1 gaattcttta aaattattta aaattaagag ttataagcaa ttctaatttc
  51 atctaatggt tcactgaagg ctgggctagg acctggtgtc taaattttt
 101 tttaaacgat caaagccttc agagccgagt ggccagtcct ataatcctag
 151 gccactagaa aactgaattt cctgaatttt ctgaaaaagt ttttcaagta
 201 gaaagccttc tgggattttt ttttctttt tttttccag tccccacttt
 251 ggatgtagta aggcttctaa aggtcaagtt atcttgagct aagaaccttt
 301 agatactttc actttcagct tattccttgt ttttgaggt cttttatag
 351 gtaaagagaa atcaaaacag cttctatctg gctccgttaa ctacttttat
 401 gttccatcct tgaaattcat ttatgtcagc atctgttaca gtacatagta
 451 tgtagtcatg ttttcttcct ctcatcttat ctggtgtcac ttctgccta
 501 agtgtgccct agctaagtcc ttaggtcttc ttggtgtatc cctctcttgc
 551 ttggatatac catcttttg ccttccattt ctgtcttgaa gaatactaaa
 601 tcttcaaaca tattatgtat ataactgcct tcaggctctt ttttcacctt
 651 ccaatccagg ttcttttcta tacctagatt aatctttctg aaaaacacct
 701 ttccctctaa gaaacaattt ccttagtttg atataagatt ctttatattt
 751 ctgttcagtt tttaaaattt actaccttcc agtccatact tgaaccagct
 801 acctcaccag attaactact catctctccc tgagcagagc tcactgttca
 851 ctattcactt gtgctcttat gtacagggct ttctgtttt tctcttaccc
 901 aagcttcccc tttgattgct gttgcccagg aagactccat aacacttcca
 951 tttccctttt caaagccttc ctaaaccatt ttaggcctta gtaatctttg
1001 tcctcctgcc ccattctttt gatatgcata ttgcttatct tctgcatgaa
1051 gattctaaat tccttcaagg tacaatctgc tcacacaggg ttcctagcac
1101 agtgctcctt atgtgatagg cactaaatga acattttgat tatttgtaaa
1151 atttgggtgg ggggagatta tcttttgac tttatacctt taattacctt
1201 tatgactaga aggtgcttta cagtaaaagg agacaatgtt gaactataga
1251 gccttaaaaa cataattaaa tgaatatagt ttttaggagg actcttctgg
1301 ttaaaaggtt taagtagatt ctgtgcacaa cattgagaag tgttttaaac
1351 ccatttgtag tctcatttat aaaggagtag agtaagaaaa catcctgaaa
1401 atccatgtga ctgtgagagg actgaggaag cctgagcaaa attgaacaat
1451 tggactaaac tttactgagt tctgatgggc tctgtgattt atttggggtg
1501 gtagatttac tcatatcctt gtgtatggtg ttatatagca tcatagtccc
1551 catctatgag tcattcattc aaccaatatc tgttgagcat ctactctctg
1601 ctaagcattg ttctaaacac taagactaca acagatattc tgatgagggg
1651 agtggacaat aaataagcaa acaaatagat tgtggtaagt gcaatgcagg
1701 ttaattaaaa tagaatgggg taagagagaa tgactgggta gttaaggaag
1751 tcttcttgga aatgacattt aaacagatct gagtaacaag gaagtaacat
1801 gtcaaaatca gaaaacatt ccaagtgagg aaataactgc tagcacaaag
1851 accctacagt ggagtttcaa gaggtagtta aggatgaaat cacataggc
1901 cttgtaggca tggtgtggaa tttagatttt attttgagta agatgggaag
1951 ccattagagg gttctgagct aagcagtgat aaaaagtccc tctggcttcg
2001 gtgtagaaag tagttggggg tcaagggcaa gaatgtacac tgggaaacta
2051 gctagtggta taattacagt cactcaggaa agataggaga aaggaggctt
2101 tcattaaagt ggtcgtagtt gtagaacagt gaagtggagg taaagttaac
2151 cagatatagt aagagattgg atgcggttta gagaagaatc aaggatgtct
2201 ccttttttgta aggtcaaccg agaggaagaa tagacccaaa gtcagccgag
2251 taagtttatt gaacctgccg gctgctccac tacagacaga ggaggaagcc
2301 ctgagcttat aaaatgaggg gtttatattg gggagagaga ccctgggtc
2351 gtttgttggt taactttatc atatatcacc ttgtgacatt tgtggtagca
2401 gctaaatgaa ggaacttaca ggtaggtgta ggtaaagctt gtttgtgctt
2451 cccacgacct cccctgtgc ggtcccaatg gcctgtaatt gggatttgct
2501 tatcacagca aggcctgata ggtgaagtct gctggcttca ttgtggcacc
2551 tagataaggg cttagaaatg taaggggct cagagggaaa ggtgggcagc
2601 acagagaaga gttgcagagc ataaggggga gggggtggg cagcatggag
2651 aggtttgagg ggagcgtcag cagtaccaag attttttggg gcagtttgtc
2701 tctaacactt ttgacttgag caactaggta gatggtagag cttttttactg
2751 tggggagaga aaaagagggg caggtttaga gaagaaaaaa tcatggtttg
```

```
2801 atattggact tgaggatctt taagttcagt agaggagaaa atgtaacaat
2851 acaggtatag ttaaatttct ataatagaaa aatacctaga ttggaattat
2901 atttctctat tgctttataa caaattatcc caaaatttag cagcttgaaa
2951 aaacaaactt atagtttctg tgggtcagga attgagaacc agcttaactg
3001 ggtaattctg atgcagggtc tctatgaggt tgtaatcaag atgtcaactg
3051 gggttgcagt catctcaagg ctctcctggg acttcactca ctttcaggtt
3101 cactcacatg gttgtctcca ggaaccctca gttcctcacc acatgagttt
3151 ttccataggg aagttacaca caccgtcatt tctgctgtat tctgtttgtt
3201 agagtgagtc attaagtata acacacacac aagggaaggg ggattagact
3251 tcaccttttg aagaaaggag attcagagaa tgtgtggacc tctttctaaa
3301 ctcacaaaga atgttaaaag aagaaacaaa gcaagcctaa agcccatgaa
3351 gaatcaccag attatagctt gttcctctga ttcttattta gtatcaaaat
3401 attaggtttt acacttgtat tcccaggacg gactctaaaa ggggaagtac
3451 agttgcatac tcttcatata tgccaagtat ctattggaga caagcaattc
3501 tcaaagaaca agccattcca agctaaaaaa aatgtatttt atcatttggt
3551 tgaagctgtt tgtctcctat cactttgttt attaagccag tatcattagg
3601 tatcaagtgt attatttaat gtctttctgt tctcatcaca ggttattgct
3651 tacaactcag aaggtaaaag taatccaagt gaagtagtag aatttactac
3701 ttgccctgat aaaccaggca tacctgtaaa gccttcagtg aaaggaaaga
3751 tacattcaca cagttttaaa ataacctggg gtaagatatt atgcatgttt
3801 atacattatt acttttgcgt ttgattaaaa taatttgaat atgaagataa
3851 tttttaagat atttgagtaa atttgttatc tcaagccagt ccaaaaagaa
3901 atgtgagagt cattcattgg gtatgttttt tgtggaaaac cttatactct
3951 catacatgct aggttaagat atgataaaaa ggaacttgcg atccactgta
4001 agataatgag caggggtagc actgtgaaat gaaggattac tgaacttgca
4051 gctaaagtca cctgggtcat ctggctctcg taagaaatga aaaccattca
4101 tttaaaacaa acatttatcg agcacctacc tacataccta atggaaaaac
4151 aaagatccca taaacttgac ccttgcctga aaaattcaga ccaataaaaa
4201 tgcttcagtg atatttataa tattcaaaaa tttcaaacaa ccttaacatc
4251 taaagtaaat ggaggctggg catggtggct tacgcctgta atcccaacac
4301 tttgggaggc ccaggcgggc agatcacatg aggtcaggag ttcgagacca
4351 gcctggccaa catggtgaaa ccccgtctct actaaaacta caaaaattag
4401 ctgggcatgg tggcacatgc ctgtagtccc agctactcag gaggctgaag
4451 caggagaatc gcttgaaccc aggaggcaga ggttgcagtg agtcgagatt
4501 gtaccattgc attccagcct gggcaacaga gtgagactcc atctaaaaaa
4551 aataaataaa aataagtaaa tggaatatca tgcagccatt aaaaattgtt
4601 atagagagcc atattttaaa tatggtaaat taagtgaaaa gcagatgaca
4651 acagcatgga gtaattgggt actggtatta agtcattgca ggtgattttt
4701 ttttttttaaa cctagtttgg tattctgttt attaggtttt tttatcatt
4751 tttatgttgt tttgtacctt gcctaatact actttgcttc tttggataga
4801 tccaccaaaa gacaatggcg gagcaaccat caataaatat gtagtggaga
4851 tgcagaaagg ttctaacggt atgaatggat attaaacact gatagattta
4901 ttccagccag tctctttcta ttctttatgg ctttacattt tatgtcatat
4951 cttttctttc ttcttgcttt tcataaggta caccataaaa agatgttcac
5001 ttcactttgg gttgtcctgg attttttttt tttaatgtca taagtttatt
5051 gacaaacata tctagtatgc catatgagtt caagtttgat ccacttccag
5101 aggctgtacc tcttaaaatg ctcttcatat ctgttaatgg atgaactgaa
5151 acatccttat gttttaagta gttgttgtct tactacaaga aagggtgtag
5201 caaatgcaga tccaaagtac aaacacatct tagctagtaa cgaccacttg
5251 tttttccactg aaaatggcaa attcttccca gggccctcct cacagtggct
5301 cctacggacc acagaggttg tgaacctccg gatgctctgg cccaacgtag
5351 cgctgctgga agctctgcga aaggcacaga aaccgaggac ggatgaaatg
5401 gcggcacctc accaagacct ttttttttc ctggattttt tttttctttg
5451 tttgtagcag ttaggatttt gcctgttatg atccacttta aattgtgatt
5501 tccagaaata cagtgaatca aatgtaagag tgctgaacaa ctgtatcgtt
5551 gcatttacat gttctttttg ttctcattta tttacattgc tcagcctcta
5601 tacacctaga ccaagtcatt agatactatg aatcttctga aggttagttt
5651 attcagttag atttatatac agatatatca gagaaggatt aacttctaaa
```

```
5701 atttaactca catcatacta gttttagtag taagttttat gactagtgaa
5751 ctttattctt gaatcacaca tttagcagtg tttatttcta tgaaatgacc
5801 tatttcctgc caaaaagaaa aaaaagatgt cttttaatta ggactagact
5851 tcctctgata ctggttttt gtactctttg tatgctataa cgttattact
5901 ggaccagtaa acacatttaa aatgcttaat taaaagtaaa ttatcaatct
5951 aggccaaagt ctgtacagag ttacagagat atttcacttc cacaaagcca
6001 tgcagacttg tctaggaagc tgcacacata aagaaaatta gatcatttcc
6051 aggaaaccga aacaaaccta aattgtttct gacaaattac acaaatactt
6101 actttgtgaa gctaggatac ctgatgtgtc catgatacca gaacgttaaa
6151 cattacctag tatctgattg aacacaattc ctcaccttac aggaaacaaa
6201 tgggaaatga tatacagtgg tgctaccagg gaacatcttt gtgatcgact
6251 gaatccaggc tgtttctatc gtttacgagt ttactgcatc agtgatggag
6301 gacagagtgc ggtaatactt atatgtagat tcttttgtgt tgttattaag
6351 tttggccaaa tggggtagga tcaccaggtg ccacttcaaa tattgaaaca
6401 tatccacaaa tggagaaaag taacttctgt aacctgttgg gttaatttga
6451 tagtgaccaa aatattctaa tgtggtactt agctcacagt aagtattcag
6501 tgtgtgtctg ttgtctggtt ggtattcagc tttggaaaaa caaatacatg
6551 aaaacattgg agaaaatttt ataaagataa atttgagaat gatgctcaat
6601 aaccatacta agcagagata gaaataaaat aattatagac cgatttactg
6651 ctccataaat tatgtgtgtg aggacacatc ataaaatagt atctgctgtt
6701 taatctactt tctaatattt acttacttca aaaaagttgg ccattatttt
6751 attattagag actcaataac caaaatgaac ttaaaatgta ccattgatat
6801 aaagacataa tgttctaggg atgtatgttt attaatgagt gatttttttt
6851 tttttgggga aacagtctca ctctgtcgcc caggctggag tgcagtggca
6901 cgattggggc tcactgcaac ctctgcctcc tgggttctgc aacctctgcc
6951 tcctgggttc aagaattctc ctgcttcagc ctccctagta gctgggacta
7001 caggcgcccc ccaccacaac tggctaattt ttgtatttt agtagagacg
7051 gggttttacc atgttggcca ggctggcctc gaactcctga cttcgtgatc
7101 caccggcctc agcctcccac agtgctggga ttacaggcat gagccaccgc
7151 acccggccaa gtgattttt ttttttaaat gaattaaacc aagaatggtt
7201 tcttggatca ttcataattg ctgggttttt ttttgaaat gaaatttaat
7251 gcaatgaaag tattcttttt taaaaatgaa atataggcat tttgttgaaa
7301 atgaaactaa tgtgcaactg agtgtgagtc ctgcccaact ggcttgtgct
7351 ccagttgctt cattttatcc agtaagaaaa tctccctgga tttcagaaaa
7401 gcaacaacac atagacatgc acaaaatcct gttctactat agcattttac
7451 agcatttta catagatagc tttctgataa aaagatgacc aaatattttg
7501 tgtttaaaaa gaatgttaag tatgaacctt aatatgttgc aagtaagtaa
7551 tatgccactg agtttgtggc attgtttttt ttgagacaga gtctcactct
7601 gttgcccagg ctggagtgca gtggcacgat ctcggctcac tgccagctct
7651 gcctcttggg ttcacaccat tctcctgcct cagccttcca agtagctggg
7701 actacaggtg cctgccacca tgcccggcta ctttttgta tttttagtag
7751 agactgggtt tcaccatgtt aaccaggatg gtctcgatct tctgaccctg
7801 tgatccaccc gcctcagcct cccaaagcgc tgggattaca ggtgtgagcc
7851 accgcgcccg gcccagtgtg gcattgtttt taacagagtg tctttaaaaa
7901 taaggcttt ttaaaatata aatatagcat agaaactaaa agcagtatca
7951 aatacctaga aagatgccaa gtaactggaa aagcttacct gattttagaa
8001 ttatttttag gtggaaagga tgaaggaaag ataatctttt aatgtataag
8051 ttaagcttgg tgcagtgaca aatgtgtata gtctcagcta ctctggacgt
8101 gggaggattg cttgagccta agaatttgag gctgtaatca tacctgtgaa
8151 tagcaactgc attccatcct gggcaacata ccaagacccc atctctaaaa
8201 ataaataaat aaatcagtgt ttaggttaaa aatacagtct acagtagtaa
8251 agtagccaaa atattctaaa cctccttaca acaatacaaa cagcatatac
8301 agtattttaa aacatccctc cttagaagag atttatggat cctttggag
8351 aagatcaaaa atattgccca ttaaattgtg ttggaagttg ttttttttctt
8401 tagttatgga aagaaaagga aaggaagggt tcattgaagt tcttttttcag
8451 taacttgctt tgtatatagt agttgcacag tacatgtctt tctttgtcta
8501 tgaaaatttt gagttttat ttaattgggt tttcattttt tttcagaact
8551 ttattccttt tttgttgaca atcaagtaca atttcaaatt atcagtgcaa
```

FIG. 5 CONT'D

```
 8601 tatttgtgtt tatattattt ttccttacca aaagcaatct gattatttgg
 8651 ttttggggca ttttttgtttt cttttttgctt ttgtttttggc aggtctctga
 8701 atctttactt gtgcagactc cagctgtgcc tcctggccca tgcctccctc
 8751 ccagattaca gggtagaccc aaagcaaaag aaatacagtt acgatggggt
 8801 aatttccatt ttggtaataa attataatta agctagaaca ggaagtattc
 8851 gtcttgttaa attgcattaa tctttccatc ttttaggacc ccctctggtt
 8901 gatggtggat cacccatttc ctgttacagt gtggaaatgt ctcctataga
 8951 aaaagatgaa cctagagaag tttaccaagg ttctgaagta gaatgtacag
 9001 tgagcagcct tcttcctgga aagacataca gcttcagact acgtgcagct
 9051 aacaaaatgg gggtaagaag actgtgctgg tagaattata atcacaatgg
 9101 tgatatatgt ttcattttaa catatatcat catatccatt atttggccat
 9151 ttggctttaa catatgactc caaattttac aattttttaac aagcctacat
 9201 tgataaatac aagagaagtc ggtatattcc ataacttaat ttttatgaaa
 9251 tctcagtatt tttagatccc acttacagtt tgtgacactt tggacttcag
 9301 ctgggctaga gtttaccttt taggcagtgt taatagagtt tacttaatca
 9351 atttaagagt agaaataaaa tcataagtac tgaagttttt tgaggctgat
 9401 tgaagttttt gaggtttttg aggctgattg aagttttttg aggctaaagt
 9451 agcatttact ttcagttggc aactaattat gattcattt ttttgcccaa
 9501 atgaaaaaaa acttatgctt gaaactattc tggttttgta tgtattttt
 9551 gaaatattat ctatgtattt aatatataac tccaaaaagt ggacaaagta
 9601 ggtgatatct ccatttcaca actaaggaaa cgggttcagg aaagctaaat
 9651 attttgccca cagtcataca aactaataag tgatagaggt aagctacaaa
 9701 ccttagtttg tcagactcca gagccaaagc tctttccact cagctatgac
 9751 acctctcatc tctctgcaat aaagcaggtt ccctaaggac aaagcagtaa
 9801 tttcctatct cagctaaata acaatttctt tcaactattg tataattaaa
 9851 atttttatag aattaaactg acagttctct cctacccatt attttggtga
 9901 actatactat atttcaaatc ctgttttcca acagggttct gtatttacat
 9951 ctgtaaactt attttttcaat ttatttctgt ttgattttt gaaacagggg
10001 ctcacccctgt cacccagggg ggaatgcagt ggtgtgatct tggctctctg
10051 caacctccgc ctcctgggct caggtgaccc ttctacctca gcctcccaag
10101 tagctgggac acaggtgta catcaccaca cctggataat ttttttcatat
10151 ttttagtaga gagagggttt tgtcatgttg cccaggttag tctcaaactc
10201 ctgggctcaa gagatctacc cacctcggcc tcccaaagta gtgggattac
10251 aggcaagagc cactatgccc ggcctaaatt tcttatatgt caaatttata
10301 tactaggct gctcttacac aagtcattcc tttctgtaag aagccatctt
10351 gtcagcctca caaggctgca gtacactagg atcgcatctt taatacttac
10401 gtcttaattt atattttcag gtttgtgata atttgtcaaa atcaccttaa
10451 gtaaatattt actttccgta tttccagaga acatacattt tagacctttc
10501 taaagctatt ccagatttta agataaaatt tatgcctacc agagagcagt
10551 actgataaat aatgtactat aagtacacta tttacagttt tatttttaaat
10601 aaaatccatt cagcatgcta gaatggtgaa gctttgtcat tatttttgttg
10651 ttgtcgacat gaattaacct tgttcaaaaa agggggggcaa aaaaatgaca
10701 tttgtcatgg aaaacttttt ttaatcccta taggacttga ggaacagaat
10751 ccttacttca gttcttataa atagttgtgc taaacctcaa gtttctatca
10801 tttagtggcc ctttcatgc tctccatgaa ctaaactgaa ttatctgtgt
10851 gactgatatg ttttcttagg ttgccttata acatgtataa cagtactctt
10901 tatttgtaga tacctttgta tgtatgtgtg tgtatagaca gatagacaga
10951 cttttttttt gagacagggt atctgtcacc caggctggag agcaggggta
11001 tgatcatggc tcactgcaac ctcaacctcc caggcttaag cgatcctcct
11051 gcctcagcct cctgagtagc agggactata ggtgcacacc accataccag
11101 gctgattttt tactttttta tagagatggg ggtcccctta tgtttcccag
11151 gttggtctca aactctcggg ctcaagtgat tcccccacct tagcctccca
11201 aagaggtggg attacaggca tgagcctctg cacctgacct tttatatata
11251 cttattattg taaatcattt gctgccacta gcagtctgta agtctatact
11301 attaaatgac atattggcca ggcatggtgg taaatgcatg taatcccagc
11351 actttgggag gccaaggtgg gtgggtcact tgaggtcagg agttcgagac
11401 cagcctgacc gacatggtga aaccccttct ctgctaaaaa tgcaaaactt
11451 agctgggcat agtggcgtgt gcctgtaatc ccagctgctc tggaggctga
```

FIG. 5 CONT'D

```
11501 ggcaggaaaa tcacttgaac ctgggaggcg gaggttacag tgagctgaaa
11551 tcatgccact acatccagcc tgggcgacag agtgagactc tgtctcaaaa
11601 aaaaaagcaa ttaaaaacaa aaaactatta aatgacagat ttatatttgg
11651 aattttggct aggcacagta gctcacacct gtaatcccaa tacttgggga
11701 ggccgaggct ggcagatcac ttcaggccag gagttcggga ccagcctggc
11751 caacatcggg aaaccccata tctactaaaa atacaaaaat tagctgggct
11801 tggtggtacc cacacctgta gtcccagcta ctcaggaggc tgaggcacaa
11851 gaatcgcttg aacccaggag gtggaggttg cagtgagctg agattgtgcc
11901 actgaactcc agcctgggca acaggctttt tctcaaaaaa ataataacat
11951 atttggaatt ttaaaattga ttgggtttc aaatttattg ttttaaatta
12001 ggaacttttg aactactaat aaaactatct gccatagttc attgattttt
12051 acatgaaata tttatttca agatggtttc aagattactt ttcacaaagc
12101 aggcgcatta tatcaccatt ttgctctgcc ttgtaaactt gccatctggg
12151 atttttgggt ggtattcatg tgagagtaaa gcatattctc tagcagtttc
12201 ctatagctac aggtttgttt gttttttttc attgcttcta acaggatata
12251 gttactatga gtccatgaaa tataatggaa atgtgaataa ggagtttact
12301 gaagacttta aacatttgat tttttttttaa tcgtgaatat gatagaaact
12351 ggtagtgttg agcagtgcaa atatttgaag tggtgatttg tgaaatagcc
12401 cagcattgcc ttaaacaaaa tcacagtcta cttcttgttt tatacatatg
12451 atagtataaa aggtttcttt tttttcccat tttctgagat ttatagattg
12501 gtatatagct taaactata taaagtttta tggaaagatt ttttaaactt
12551 attaatataa attttaaagt tgatataatt aaagtgagcc tatcttctgt
12601 ttataaaatg caagattcct taacatttat aattatacag atgaaatagt
12651 ttctataagg aagttggagt tttgattttg ccctttatag atgttagatt
12701 gtgcagattt gtctgtattt tctcaccata tcaaataata cttttattat
12751 aagattggtt ttcaagagcc gtattagttg ttataattga ttagtatata
12801 gtttaacttt attcatcata tttatactgt agatttatgg ccagaggttg
12851 aggttatttc aggagagttg atgaccttca tttaaagtct agctaaaatc
12901 agtgctgtaa acaaaaggaa acatttacgt ttgtttctgt ttgccatata
12951 tagtagcctt gattttttac tttttttataa aacagttacg ttcacaatat
13001 tagcctgagg tattaatgac attgtgatga tacaaaatgg tgtatattcc
13051 ctgtgcaatc ggatttggag gaaaaatgaa ggacttaaca ttatctgaag
13101 tcactgatac tctgaataag tatggtcaag gagtgaacta ttttcttttg
13151 gaaaaacttt ttaaaatttt attttttaaag tattatactg ttatttttag
13201 ggcctaatgg ttacattgaa tagttggttt caccttctta aggtttttta
13251 ccaatattca tgaaacttga tatttttaaa atccctaccc tttggtaagt
13301 cgttatttat taacattttt attggtgatt aatacatgtt ttttcctaaa
13351 ttaaaaataa ataacttgga ataatttaa tattaaatat ttgttaacaa
13401 ctgaatgttt ccatagaatt ttctgagaag ttgagtttct tagagttttc
13451 gtagctggct gggcccagtg gctcatgcct gtaatcccag cactttggct
13501 caagcagtcc tccctctgag acaggaggac cacttgtgcc caggagtctg
13551 agaccagcct gggcaacatg gtgaaaccct gtctctgtaa aaagtagaaa
13601 aattagccca gcatggtagt gcacacccgt agtcccagct actcaggagg
13651 ctgaggtggg aggatggctt gagcccagga agtcgagggt gcagtgagcc
13701 atgtttgcac cactgcactc ctgcagtcta ggtgatggag ccagccagac
13751 cttgtctcaa aaaaaaaaa aaaaaaaaaa aagaagttg agctagctct
13801 taaagatggg catttggcaa aactgcctga tacagtgcag taacaagtag
13851 gtttacttct gaccattata atgatgcgcc actgttaagt gaaaatacca
13901 gtgtattggg gcttttcttt tgctaatgag ctttgaaaaa ttgatgacaa
13951 gaaatttctg taattgttct cctatgtgtc ggggaaggaa tttgccaata
14001 ctgaataaaa ttttttatat tccgggtaat gtatgttaaa agtaattatg
14051 agaaagtgag cttttagca tggaacagaa aaatcaaatt ctgttacaaa
14101 ataaacaaat ttatagaaca gaatgttggt aaaatttgat atggaatatg
14151 cctaagaaag attcgtgaag tattaaaaaa ttaaaaataa taatttacac
14201 ctaccatctc ccgtaccttt aattagtatc aatttcttca ctccttatat
14251 ttctcctgaa ttattccacc gacctcattc cctaatgtcc tgcccttctt
14301 acaaaaacca tttcctgaag aaataagggg cagaagaaag tataggtaaa
14351 tgaaactttta aatttctca cacctttact ttcatgattt ttaagtcttt
```

```
14401 ttagttaatg tgaatactta tagaattatg accaaattaa tcttgaaaca
14451 cagggaaaag actttattaa tgaatcttta aatatgcagt tctgtgcaat
14501 cagtggacat ttaagggtga aaaataaaaa cactagttac atttgttttt
14551 ctagtttgga ccattttcag aaaaatgtga tattactaca gcccctgggc
14601 caccagatca gtgcaagccc cctcaagtga catgtagatc tgcaacttgt
14651 gcacaagtga attgggaggt attgtaattt ccattgactt gtatctactt
14701 tcttaagtga atagaatagt ttatataaaa gaataaagat actgttcatt
14751 tttaccgcct atattataca gagtaagccc tagtttaatt cacatgaaaa
14801 acagtgactt ctttttcctc tttgaagaat ttgagtaagg tatatttgca
14851 ttacaaatat ttagattcct gttcattatg tgctttgtat ttttatgaat
14901 ggctttgtct cagtactgag atatttcagc cactgtaagt ttaatgttca
14951 gaatagacat acacaggaat tagtaaattc tatttctctt atatttatcc
15001 agtacacatc tccagtgtac ttattgtgga tagtaataat cagtgatgat
15051 aattattata ttttcagttc cctttgaaat ttaacaaaat gtgtgtatgc
15101 ttttaacatt tcatattaat agaattatct tgaaacatat ttaccttaaa
15151 acactctttc taaagtgact tagtcatatt tctacttcta attcaaaaca
15201 gttatatatt tgaccaatct taaattcaga taatcttaat gaataaaaaa
15251 tgtaaaattg aacagttttg attgtgctta aaagttttaa agaaactcaa
15301 aagcaatcta gttttacatg tgctcaggta aagagcattt ttggccaaaa
15351 gctatttaat caacatcaag actaagacct ttatccttt cttaatttaa
15401 aggttccttt gagtaatgga acagatgtca ctgaatatcg actggagtgg
15451 ggaggagttg aaggaagtat gcagatatgt tactgtgggc ctggtctcag
15501 ttatgaaata aaaggacttt caccagcaac tacctattat tgcagggtcc
15551 aggtaaagat gatcagtacc ttgtcactta actctatcca gagttttata
15601 tttcattggc attttcatgg tcatgacttt gttaactcgg aggctctgtt
15651 aatttgtagg ctctgagtgt tgtgggtgca ggccctttca gtgaagtagt
15701 agcctgtgtg actccaccat cagttcctgg cattgtgacc tgtcttcaag
15751 aaataagcga tgatgagata gaaaatcccc attattcacc ttctacatgc
15801 cttgcaataa gctgggaaaa gccttgtgat catggttcgg aaatccttgc
15851 ctacagcata gactttggag ataaacaatc cctaacagtg ggaaaggtta
15901 caagctatat tatcaacaat ttgcaaccag atacaacata caggtatact
15951 ctaaaaatta tgttgatttt tgcctagacc agagagacgc tttaaataaa
16001 acaatcataa ccaaactttt tttcttatgt ggcacttaga atacgaattc
16051 aagccttgaa tagccttgga gctggtcctt tcagccatat gataaaatta
16101 aaaactaagc ctctccctcc tgatccacct cgtctggaat gtgttgcctt
16151 tagccaccag aaccttaagc tgaaatgggg agaaggaact ccaaagacat
16201 tgtcaaccga ttctattcag taccaccttc agatggagga taagaatgga
16251 cggtaggttt ttttaattgc ttctttatat agtttcttag gtcttaagta
16301 tatacatttc tgtaactatt agaagtaggc caggtgtggt ggctgacacc
16351 tgtaatctca gcactttggg aggctgaggc aggcgaattg cttgagccca
16401 ggagtgcaag accagcctgg gcaagacagt gagaccttgt ctctaaaaaa
16451 aatttatttt aatgaagtaa gttttcaaaa acgaagtcaa gattgtcata
16501 caaaagtgtg ctgttttta aacgttagaa aacacaatgt acatttcctg
16551 tttataattt gtgagtggaa taccaagaga aaaaaataag tgggctactg
16601 tttggttgtt ttctgtaatc catttactgt tttcatgata gtaaaagaca
16651 cctaatctta gatacaaaat aaactcttca gtgtttattt ctagcaggac
16701 acaatttttt tttttaaga caaggtcttg ctctgtcacc caggctggcc
16751 tccagtggca ctatcttggc tcattgcaac ctctgcctcc agggctggag
16801 ccatcctccc acctcagctc cccaagtatc tgtgaccaca ggcgtgggcc
16851 actacacctg gctaattttt gtattttag tagagatggg gtttcaccat
16901 gtcgctcaca ctggtctcga actcctgggc tcaagtggtc ctccccgctc
16951 agcctcactg agtgctgaga ttacaactca tgagccactg tgcctgaccg
17001 aaacaattt ttttttttt tttttgaga cggagtctca ctctcaccag
17051 gctggagtgc agtgacgcga tctcggctca ctgcaatctc cgcctctcag
17101 gttcaaacaa ttccctgcc tcagcctccc aagtagctgg gactacaggt
17151 gcgcaccacc acgcccggct aattttttgt attttagtag aggcggagtt
17201 tcaccatgtt ggccaggatg gtctccatct cctgacctcc cgatccacct
17251 gcctcgacct cccaaagtgc tgggattaca ggcgtgagcc actgcacccg
```

```
17301 gccctgaaac aattttatag taaatgatta tgatcgttcc tggcctctga
17351 gatccttgag ggcagagatt atgtttcagt cttttccaga ttcctgacac
17401 agggcctgca cgctaaatga atacagttca gttttcact gtgtgatctc
17451 agttagattc tgtgattaat tatctagtcc ctttgctaat cactgttgct
17501 aatctttgct aatctttgaa ttagaaagaa cctaatttca ttcaggttct
17551 ttctgtgcct ctttcacatc ttcatgtaca tgttgtacta ttcctatata
17601 atgtgccata tactgccaca ctaaatcatg tattttaatt acagtgttaa
17651 ctctgaatat ttgtaacagt cattctaatg ccaactaggg ctatttattc
17701 acattatatt ccatataagc aatgccacat acctcccaca gctgttaatc
17751 ctttaatatt ttaagaattt tgaattttgc ttttctactt ttcactgaat
17801 atattagaaa caatttccaa atctgatgga ctcagaatac tagtaacagt
17851 ttttcccaag atttactttt ctgtgttgtt tgtatcttag ccaggtattc
17901 aacaatgaaa tattcatggt gcttgtacat aaccactctc tatcagaaat
17951 acttatacat ttaaaataac atatggaata attttgtata ctagtatatc
18001 accagtaaga acattacaca gaacaaacgt gatcatttcc taaaatctgt
18051 atcgatgaat gttagccttt gttcttggca gaattttatg taatctttgt
18101 agccttatct ctacaaagag attatttgcc ttgtacaggt ttttggtata
18151 gccatttatc tttaatatat gttattatta ctggacaaat taattgttta
18201 aattttttc ctcccctttc tagcatacat ttggggtagt gcaagaaggc
18251 ttactggaaa caggtctaat tagtgtttgg ttgaaagata atagaataaa
18301 gattctatta gatataaatt ctattataga acttccaact taatattcag
18351 ctagcatcta gagaattgtt atgggtatg aatatggctc atggcctttg
18401 gttgtggaaa ataaagaaat taaaaccttt tatgatactg ttaagtttaa
18451 tgcacacatt taataaatta aatcaattta atatctttga ttactttcat
18501 tcctttgat tttcacaact atatacactt gctgtgggat ggtatcataa
18551 tgatacttta gttgttccct gatccagatt ttgtcattgt tcagcttttt
18601 taaacagtgg tattaccact attttttttt cctgtcatta aaaaaaaatt
18651 tagaggttga aaaggcaagg cttatccaat tactgcttat tggaagtact
18701 gtttcttcct gtcattaaat atttctttat ttttaacttg gctacaattt
18751 tcagactgtt agcattgaat aagcattcat tattcattct ctaatttcca
18801 aaaattttag aaacatccaa tcaaaaataa tgggatgcat tcaacttata
18851 gataacatat taggagaaat atgtatgata ttcaacttca ttgaacagtt
18901 caagtgggta atgtattgga aatttttat tatcatactg cttttgtaaa
18951 tctctaaaaa aacgtcacca agtcaactaa aaatctgcct gggaattgag
19001 aattctcttt tttccagata aagacaagga agattaaaat agaaacttaa
19051 tctcatagct caggtctcta tgccatactt ggcaaatttt atcaatatga
19101 ctttagttag aaataatttg taatgaaaat tgtgatgttc tgagcatctt
19151 ttaaaatgta cattaacaaa acagtattca gaaacaaagc taaaccggaa
19201 gcctgagaag aaacagttat ggtcggacat gaaatttagt aacagacttt
19251 tggtaaatca tgtcaaattg ggaaatttac caaatatcct attttctta
19301 atctgatgaa aaacagattt attttaagtg acatagagtt cctggcatca
19351 aacttttggg gtaacttatc actccctaaat aatgttcata actgtgtttt
19401 tatactagtt tgtaaaacac tttaataagg tatcataagg tagtataagg
19451 tttatctaat agttatttcc attttaggtt tgtatcccta tacagaggac
19501 catgtcatac atacaaagta caaagactta atgagtcaac atcctataaa
19551 ttctgtattc aagcttgtaa tgaagctggg gaaggtcccc tctcccaaga
19601 atatattttc actactccaa aatctgtccc agctgccttg aaaggtaagt
19651 tatacatcct gaacttattt tctttataat aaattacttt ttaatgtatt
19701 ttcataaatg ctttgtttac tgatattaaa atttagcatc cagtatatgt
19751 ccaccagtta tacaaaatcg tataggcaag cccaactcta ctgagagttc
19801 cactcaataa taaaagctgt tttatctggc acgctcatat tcagacaagt
19851 actggctttt gtcactgatg ttttaataa tgtagcataa aaatactaaa
19901 ttgaatagga aggctggttt tctaatgagg tcatttgctt aaagaaaaaa
19951 atcacaaact ctggttgttt aaacgttttg agttattgat attacattca
20001 tttggatttc agaaggaaag cttggtcatc tgttaagcaa aacaaattct
20051 tcattaatgt gggttttca attagtttta cacacacatg tacacatatt
20101 tacacacatt tgtatataca tttatctttt aattttagag gggttcttat
20151 tttaaagtga ctctggcaag ggctacactc tatttttagc tgaaaagtct
```

```
20201 ataaagttaa ttgctctgaa gactaatcac agagacttct agaaccatat
20251 cctagatcat gtacttaaac ctatcatttg taaacagca gaactcttct
20301 tgactagtct ttctaataat attgagtttc actgagtcat ttttctgttt
20351 gctcatcaag tttagtgtct cttagcttta agaagagtgc tgactataag
20401 cagggcacag tggctcacac ctataagccc agtgctttgg gagactgaag
20451 tgggaggctc acttaaggcc aggagtattg agaccaacgt gggcaacata
20501 ctgagacctg cctctctaca aaagaaattt tgaatcagct gggcatggca
20551 gcatatgcct gtgtgtgtag ctgcacagga ggctgaggct gcattgagct
20601 atgatcgcac cactgttgtc caggctgggt gacagagtga gatcccatat
20651 cttagaatac aagagtgctg attttaacct ctttggatgc aaatttcaaa
20701 aattcactga tacttatttc aagtttataa gtggatttta aatatttgtt
20751 gatttttatt aagacaagtg tctgcatgat gtaccaaatt aaaaatcaag
20801 tggaacagat attatttata tttgtttcct acagccccca aaatagagaa
20851 agtaaatgat cacatttgtg aaattacatg ggagtgttta cagccaatga
20901 aaggtgatcc agttatttac agtcttcaag ttatgttggg aaaagattca
20951 gaattcaaac aggtatgtac caagatatta atgtgtggat gcatattttt
21001 accctttttt aatttttatg tattttcagt gtaagatttg gccatcttta
21051 ccttttaatt cataaatatt tattcagtat atattatgtt ccagagatct
21101 caagattcca aatctttca gtatgaacta cacttgaaca gattattcat
21151 ttatctgata agtattcatt gaattctgtg ccaggcactc aggatatagc
21201 actgaacaaa aagtcccttg cctccatgga gcttacttac attctggtgg
21251 aaaagaagac actataagca agtaaacatg acaatatatt gtcagatata
21301 agtgtaatgg agaaaaaaca aaattggata aagaaatag ggagtggagg
21351 gggagggcac tgagtgttat ttcatttggg gcactcagct gacatttcag
21401 catggcccag aggagatgac tatggagaga agagtgttcc aagaagatac
21451 gctgaggcag gaacatgcct attaaatctg atgaacataa aggagccaat
21501 atgactggat ggagagagca aagggaagag ttgataaggt cggatagtta
21551 atcctaaggg gcctataggt ggtatggagt gacgtaaggc ataataggcc
21601 atactgtggc ttttactcca cgtgaaatga gaagacagtg gaggattttg
21651 accagggtat tcacgtgatc agacacaacg ttgttttgac tatagtgttg
21701 aaactacagt aggacaaggg cagaactaga aagactaata aggaggcttt
21751 tacaataata gtattaataa tagtcataat gcagtgctgt aaatatgaca
21801 ttaggcatga agttataatg gaaacctaga ggaattgtca ccttcctagc
21851 caagaggttt caaagatagc tttctgataa agcaagaata gcagtgagat
21901 agagtggagt gttgccaatg tttgttacaa ctttaaaaa gaataagctt
21951 ttataccact ccaaagacta attaaatacc tatacatttc acctgatttt
22001 cccttttttcc tgtaaccttta attttgaggg cttttaagct gggttgtttt
22051 cattgtgtct tatattttcc tcttccacta aaaaaaagat ccttcatttg
22101 ttttattcca gtattgtgct attgtaacca ctctatgtaa tatcttaact
22151 gaaattacaa aagatccaaa gagtcagatt aaatctggca tgcaattgtt
22201 tttctttatt aagccatctg caaattgaca ggataattag atttgaaatg
22251 taatttacag ataagtaggt ttccttctaa ggaggaagca aaattaatat
22301 taaagaaaat ataattgtat tacacgttta aaggaaatag ggattccaca
22351 tttgagtagt atatgaataa ccttaaggct tgtttgaatg acttttcttg
22401 ggtgtataaa ccttctgaaa ttagcttgag caggttaatc tgttttcttc
22451 agtcctgtat ttacagttac ctgtgtctct tcctgcttag aggtcttccc
22501 acatctgaaa tacaaaattg aaaacttgat cccatcatct tccctcccag
22551 tatctcctct ccaacatctt tacttcatca gtgtcataga caccaatatc
22601 atcttggtct ccaagcttta aattcttaga tgaatttttt tttcctatca
22651 actcttaatc agaatttgtt tctaaatcca taaaactaca tcagggcctc
22701 atcactttt acatgtacat caagagtccc tgtcctactc agctcccttc
22751 agtccttcac acagcctcac gattaggatt ccataaacac tgttttaatg
22801 tcacacacct acagtggtcc cttttgaatt aacctaaatt tccaactagt
22851 gtaattaatg tattcttcct ctttgtacca gatctcttat caccctcatg
22901 ccatttgttg aggttttct ttcttaacct aatactgcca ggctcatgga
22951 atggtatatg aagacacatg gaaagtataa agacaaaaat catctattat
23001 atccataaga caaatacata tttttaattt ttactcaatt tacttcagtg
23051 ttatgtatac aattttacac tactttatca tacaacattc tgttttaagt
```

FIG. 5 CONT'D

```
23101  gaatcctttt  acaggttgaa  gcatcccaaa  taaagtccaa  aattcaaaat
23151  gttccaccca  aaatctgaaa  cttttgagg   atcgatatga  cactcaaagg
23201  aaatgctcat  tggagcattt  ccaatttcag  attttgggt   ttggaatgct
23251  caactagtaa  atatgcaact  attccaaaat  caaaaaaatt  gaaatgcttc
23301  tggttccaag  catttcttat  aagggatacc  caacctgtac  catctcccaa
23351  acatggatca  tttctacatt  ctattccctg  aaacattatg  catccttaga
23401  actaatgtat  agtcaccatt  ttctttcaga  tttatcttaa  agcttctttc
23451  agtaagttcc  tttatatatt  gttatcagca  tccacatttt  tatttattgc
23501  caataattca  ctaatttaat  gtccttttat  taagtaccta  ctatatgcta
23551  gattctggag  acagaaaaat  gagacagaga  tcttacttta  ctttgagagc
23601  aaagcaatat  gtaaaaattt  agatttacat  cacaggtaca  attgaggcag
23651  ctaaaagtac  ttgaaagccc  ccatgtgttg  gttcttctga  cttgtagccc
23701  accaactaac  tggagaaact  caactgacaa  gtcatttaac  cctatgaacc
23751  ttggttttct  caattacaga  atgagtggtg  ggaggttgct  cattattgga
23801  aatgatagct  cctacagatt  gagcagtgac  tgcatgctga  gcactgcgct
23851  aagtgcttta  acaagcatta  gttcatttca  tcctcataat  tatcatacat
23901  gttaactact  agtatgtctg  ttatactaag  gtagttggtc  taaaatcaca
23951  tctggagtgt  gaagtggtag  agcagacctt  ggatgccagg  ggtgaacagt
24001  tctagtatat  agcttcttat  ttatgcctag  tgttccatta  ttggaacact
24051  aagcttgtgg  tagttattta  tatctcactg  atcaaggtta  ttgccaaggt
24101  ctgatttttc  acaaaaaaaa  aatttgcaac  ctctggcata  aatgggttaa
24151  ttactagcac  attcctctga  aaatccgtgg  aatttcattc  ttttattttc
24201  ccttgtgagg  catggcagag  gaggtcctat  tttctgattc  taagtgatct
24251  cccctctctg  gtttatacag  tgatttgcca  taggcaccta  tagaaagctc
24301  cccttattca  ttttccattt  cattgtacag  atatgtttga  aattatatgg
24351  aaatttatca  gttatacaaa  gacataatgg  gggaagcaaa  agtagacact
24401  atcccttctt  tgatggaatg  attgcattga  aaatgacttc  ttacatttg
24451  agaaaagcaa  gaaaatgctt  gaggaccgat  tttgcttgtt  ctctagctgc
24501  cctggggcac  atctgcactc  cttaattcat  ctgtgaaccg  tataagggta
24551  gatcctcgct  tttgaaattt  ctcttgcccc  tatgcaacaa  acagataagt
24601  actttaatgg  acaggtattt  ttaacatgtc  atttaaaaga  taaaatcaat
24651  ggcattcact  ggctttcaca  tgaaaaacaa  ttctaacact  agccagtttt
24701  aacacatttt  ctgtccagcc  ttcacacgta  attcttcctt  ctaatatttt
24751  attaacagat  ttacaagggt  cccgactctt  ccttccggta  ttccagcctt
24801  cagctgaact  gtgaatatcg  cttccgtgta  tgtgccattc  gccagtgcca
24851  agactctctg  ggacaccagg  acctcgtagg  tccctacagc  accacagtgc
24901  tcttcatctc  tcagaggact  gaaccaccag  ccagcaccaa  cagagacact
24951  gtggaaagca  caaggacccg  acgggcactg  agtgacgagc  agtgtgctgc
25001  cgtcatcctt  gtgctgtttg  ctttcttttc  catttgatt   gcctttatca
25051  ttcagtactt  tgtaatcaag  tgaaaatata  actttatttt  taactctat
25101  tacatttat   tttgtcatgt  actaaaatta  tttctgtatt  gcttttataa
25151  aaaacagtgg  catttagcac  tggcattgag  actatagcac  atcattttg
25201  ccatttcag   tgcttatatt  gttaggtaga  ggctggcact  ttattagaat
25251  gcaagccaca  aaaatatcaa  ttttgttttt  tttgttaggg  tgggtcttct
25301  tttttctttt  ccctctctct  tttttaaca   aatgccttct  tatagaaaaa
25351  cttttctaaga ggcaacaatt  tagaatggat  attttgacga  atcggcatga
25401  gtgtaacagt  gataacctga  tctgtttgtt  ttaaagatta  ttaccaagtg
25451  aaaaattcag  aatgaataga  atttacacta  acatgctata  taaaatgtta
25501  aagtctgatg  ctgtgaaagc  aatctagtgc  tatatttcta  cctcctcatt
25551  tgtcttaatt  atttggtaag  tgggattatg  atgagtaact  ggaggggctt
25601  agaaacaaaa  actggatgaa  agagtatgca  tgaagaaaag  cttctttgat
25651  aaatgtggag  ttcttcatta  taaatatata  ttcatgaatt  cacagataag
25701  tacttaaaga  acagacagtt  tacttggcct  aaaaatattt  tgatgtttac
25751  tcaaaaagta  cctcttcagg  tcttgagaac  atggaaaaga  attgagtgct
25801  tttaaatact  ttttagaaag  taatcataaa  agtaaattga  atttcaaacc
25851  tatttggctt  ctgttttgtg  aaccctttgaa ctatatgtat  gtgtataagg
25901  gtatacacat  acatatatgg  catataacaa  gtgtacacat  atacacataa
25951  caagtgtaga  agtatatatt  acatacatac  actcactctg  tctggtatag
```

FIG. 5 CONT'D

```
26001 gctaattttg aagaactccc ataagtttct gctgcttctc ccataactgc
26051 tgccaccacc atcagaattc ataatcaaac ctaacctttt tgtttggggc
26101 accaaatctg aagacaaaat taatttgcac cagtaaactt caagctgctt
26151 tctttcttga aaactaaacg tttaacgtat aatgtctgtt tggatactgt
26201 tccaaattgt tgattgcatg tggttaatgt tgcattagag cactttgcaa
26251 ttgcataatt cattaatgtt ttgtgagctt gcatttgtga gttattggat
26301 gatcagactg aattttgtca agtatcacat tgtacatctt gcctagatgt
26351 cgatgactgc aagtaataat acagtttata atgaaactat ctacaattct
26401 tgttttagca catctgttat ccgtaaaaca cctgtaacta gcttttttaa
26451 tttattattt gaattttagg atagcgaatc actaattttt agttgctgag
26501 gttggcattt tagtgattat taagcacttc tgtcagtctt tgaaaaaaga
26551 acgtattttt tgtgctttga agatctctga agaatttctt ttataataga
26601 atgggcatgt attgtaacag tttatgtca aatgatctgt gctgtagaaa
26651 aacattaacc cttgttcaaa aaagaaatgg ataaacttgg cctttctaag
26701 tggtaagaat gacctgtcac tataatatac tgtatgttta cattttattt
26751 aaatttaatc tcttatgtat agggtgataa ccttccccag aaacaacagt
26801 gattgcgatt gttttctaga aacttcttta aagtgccaca tttggcagta
26851 caaatgagtc tgagtgtaat agcccagaga tttatatata gttgaatgtc
26901 taaaatggta aaatgtgcca ctgtgtcaag ttacagtggc ttatgttttt
26951 catagtaatt caaatgaact tcctattttt gatagtaaat gtcatttaat
27001 agtatacttg ccatttgagc ctcactgcaa aattagtgca gaggagaaaa
27051 caatttttaa tgtaatcttg attttacctc atatactgta cattccaaaa
27101 actctaaact ttttaaagat tatagataca ctaccaaaca tatcaccta
27151 aaattgtata aggctgaatg aacttcatac aaatgaaaaa aatctcataa
27201 aaatacataa actatgtagc aaaagtatct gtaaaatcca tggaaaataa
27251 aagttgtatc attcttttg agatacgttt attgtattca tatatattca
27301 ttatttgcta cctgtttaag aaagtgaaat gttatggtct cccctcttcc
27351 aatgagctta aaacattttt cccaacagta tataaatctt caacatgaga
27401 ggatgtatat ttattatata aagcccagta aagaataaaa ttagaagttt
27451 tatcctagtg acttgatttt gtgcaactca tgaaatatct tacttccttt
27501 ccacatataa agaatacagt gagtctaagg taaacttccc agtgggaaga
27551 aaatccctaa cctctccttg cctttcccac atccctattt tctagtacct
27601 tctttcgccc accaccagag gcccagaacc ttcctggtag tggcactgct
27651 gggtctgcct tccaccagaa aatccaacat tctctcactc atcccccatt
27701 aaaatttcca tcccaagaac ttcctcctgg ggatggacac tcagtgcctt
27751 ttttttttc ttttttttaat gggtaagcta gtaaatttta tgttataaat
27801 attttaccac cataaaaaaa tcattgaaaa attcactgaa gaagccaata
27851 tggaaagagg agaactcaat gtttaaaata aagccaactt ttttttttta
27901 ttcaagaggt aagtacatag cttcaagctc aaggtctagg ttgaggacaa
27951 tcatgagtcc tattaaagga caaccagttt aaagaacact gtcaggcaag
28001 ctaccacgta gctctccttc actccaggct tagctgttcc agacttccca
28051 gtactgatga aggatcatgt ttttgttcag ctttgcccag tgctgtcatt
28101 cataatagat aaatgaaaag tcccagaaac ctgttgtgtt tgggaaggtt
28151 ttcttttgtt ccaggcttca gtggttaata tgcttgacaa atttcagagt
28201 ctctatctct gtagaccaat gccaaagaat tgctttctgg attcactgtt
28251 agcagctctt cgtcttcatc tttggcaatg taagaaaacc accatattct
28301 ggcccccagc cttcacagcc acagtggaga attaagtcta gggcaaaatc
28351 agccttgcca tggtcacgaa ttaaaagtgt ggtgaccagt cttccaacgc
28401 ctcagttccc tttggcatgt gggaacacct gattcattct ttgtttcatt
28451 ttcctctgac tcggtctgtc tgctcatggc tctgttggcc gttgatgctg
28501 atggctgcct gattattctc tggctcagga gggctatggc cagtcccttc
28551 ctcagttcta tcagcagcag aggctgctgc ttcctctttt ttgtcatcca
28601 tctcatcttc cgaagggggcc aagaagtgaa gcttcaggcc tgtgaagttg
28651 gagagcagca agaatagtgc ctcagagcaa ataacttca tgcactcctt
28701 caatatatca ggaagcttac tctcctcagc tttctcatag aatcatcttt
28751 tgttggccag gcacggtggc tcatgcctat aatcttagta ctttggaagg
28801 ccgaggtaga caggtcacct gaggtcagta gttcaagacc agcctggtca
28851 atatggtgaa acccctgtct ctactaaaat agaaaaatta gctaggcatg
```

FIG. 5 CONT'D

```
28901 atgccaggtg cctgtaatcc tagctactcg ggaggctgag acgggagaat
28951 tgcttgaacc caggaaacgg tggttgcagt gagccgagat ttaaaattta
29001 aaaaatgata ataaaaaaaa aaaaaccttt tcttaggggg acctcagctg
29051 ctctcttcca catctccatt ctccaaggcc tcacagacct ttgcaaattt
29101 ctcaggctta agaaatttct taggagaatt tcagaacttt cttcaaactc
29151 ttcttgagtt tgaatttggt aatccatgtc cagataagta aggttgatcc
29201 aatcaaacaa tttcatgttc ttgtggggtg tgagggctcc aagatatgag
29251 ggggttcaaa gtagttggga ggcctagtca gtgaaggacc atgaaaccag
29301 ccacttatag acaaatgtga cttcagacag gactttggac acctggtgaa
29351 aggacactgc agatacttca agaaaaacca gtttgttcca taaaggggta
29401 agagacgaca atctgcttcg gttgaaagtg ttcatcaatg ttgtacaggt
29451 ccaggatacc ctccaggctc ctgtcccagg aaagaaccag gtacaggata
29501 aaggcgatcc agcgcccttc tagctcatca tcatggcaca gcagggcatc
29551 agtgaattca tatttagcac aggacacatc gatggttggt tccagtaaat
29601 tttagaaatg ccagaaagcc aggaccagaa atcttcaaac agaattttcc
29651 ttaaagcaga gatgtgaggc cctcttcttt aaatcatcag actgctggaa
29701 cttacataaa tcattatact tgtcatggaa atctaagttc ataagttcct
29751 tctgaagccc ttccaagaag tcgtctttgg atgaagtttg ggatcatgca
29801 gtgaagaaag gggtccatgt ccctgacaat ggcttcgtag ctccaggcct
29851 caaccacctg ctttttcaag gtttcctcca tgacggcatc tgaaaattcc
29901 gccatcacct ccttctttcc cttttttccc acccgggtcc ggccgggctc
29951 cactggccgt ttcatctcct cacaaggtac agagccacgc catatgactc
30001 agtgctttta aaatccatgt agatctctta attgccacaa ctccaaggac
30051 cgtgatagag tttaaaatgt tgggctgggg aaggagagtc cggaaatagg
30101 aacatcacag aagcagctaa gcatgagtcc aggtttgagt ggggtatgat
30151 actgatttga cagtatgatt gcacgtcacc tcttttttt ctgtagattg
30201 gaaataggag tcttttgcat cctgtttgag cattccatgg ttggtttcc
30251 aacacaaatc ccttgcttct caccattata agattatttc tgcaggaaga
30301 ttccattgac gtggtggctc aaggaggcaa acaggcttca aaagaaaata
30351 ggccgggtgt ggtggctcac gcctgtaatc tcagcacttt ggaaggccaa
30401 ggtgggcaga tcacaaggtc aggagtttga gaccagtctg gctaacatgg
30451 tgaaaccccg tctctaccga aaatacaaaa attagctggg cgtggtggtg
30501 cacacctgta attccagcta ctcaggaggc tgaagcagga gatcgtttg
30551 aacctgggag gcggagcttg cagtgagcca agatcgtgcc actgcactcc
30601 agcctgggtg acagagcgag actccatctc aaaaaaaaaa aaaaaagaaa
30651 atattccccc aaacttaagc agtgattctg taacctaact cccatcatca
30701 aaagagatga tgcctcatgt ttttagagag tttttaagtg ttctattttc
30751 atatacattt tgtaagtata tgccgttgag aatgtgtatc ccttttgttt
30801 atttatcatt ttctctctga tgctcctaag gcgggagaaa aaacttggag
30851 gaaaaaaaga aaatcaacca aagaaccaag atttcaacaa ggtggtcatc
30901 aaattctgtg tccagagtgg tgccttcaaa tgtttagatg ctgtaatggc
30951 tatttttttgt ctcataaacg gggctattgt gccatttcca cttactacgg
31001 gaaatttgcc aagagaaaag ggtttcaaaa ctgaacagat tttgaagcca
31051 catgcccat tcaaatcatt atggctagga tctgtcaacc atttaatgtg
31101 ttgtaagcat tatgttcagt tctttacctt gggcatctca tacagtcctc
31151 ttaattgctc tagtaagcat tatctgcagc acagagaagt cgagctctct
31201 gccacaggtc tcatggctaa taaatgatga agctggggtt tgatccaggt
31251 ctggggctcc cacacttgac cactatcctc tgctgtctgg cccaaaattt
31301 acaaactcta ggaaatcaaa attaatatga attgacttta atagtgcgtt
31351 tatgatagca tttattgatt gagtaccacc tgtttgctag gcaatgtgct
31401 aagcacttcc tcatatgcaa aacaagccac agccctctaa ggactgaaca
31451 gaaagaaatc agatgagaag aatctggtat aagcataaca gactaaatga
31501 gaaaccctaa tttcttttcct cttgaatttc atccctgat acttttacta
31551 ccattttgag cccacactca atccttaagg ctagcccatc ttaaatatta
31601 atccaaggat gaaaacgcca ttttgccac ttaccgcaac taagacaagc
31651 tgacattttc aaaaatgaat atagctacca tgtggaccaa cctcaaaaac
31701 acactacaat gaaggaagcc agacacagaa agtcacatat tatacaattc
31751 catttgtatt aaatatccag aatgagtaaa tccatagaga cagattagtg
```

FIG. 5 CONT'D

```
31801 gatgccaggg ctggagggag gaggaaatgg ggagtaactg cccagtgggt
31851 gctgggttga tggaaatgct taggagccag acagaggtag tggttgcaca
31901 actctgaggg cactaaatgc cagtaagttt gtcacttcag aatggttaat
31951 tttatgtgaa tttcacctga attgcttaag aagggaatat aaaacctata
32001 aactgataca caggtaacat aagactagag aatcctgggc atcaagtcca
32051 taaaactgac gtagtcagta agttcatttt gctaaggaca gaggccaact
32101 tgtctctttt ttctcaaact cccacacctc ccaggatgct accactcctt
32151 tcagcctgtg acatgtgcct ggcttacaac tgaatatttt atggatgtcc
32201 ttgagtgtga ttaaacaatt tcgcctgccc acacccaagt tatcagctct
32251 atctcattct taatccttct aggatgacac agaggtctta aagaagaaat
32301 taccttttca gtttcacagt taatcaatgg cagcagctgc acagtaagaa
32351 tgctcgtatg cagtagtgta aggcctataa cctcttccca cccacgcttc
32401 caagggcttg ctccctctcc accatccccc ttggtaattg ttgccacgct
32451 gagcctgtct gtctctcagg agaaactggg actaacagaa aaactgctaa
32501 agcaacagcc acagagtaac aggaatctgc actccacaaa agtcttgcct
32551 gaatttgccc tgccgtgtcc ctgctgtgta aaaagaaaac ctaggaaaga
32601 ctgagcccct ggtcaatgtg gcggtcaggt cctggcggtg agattgggaa
32651 atagctggcc ttgaacttct ctgccagggg ctcccttcca gggccagctt
32701 tgctatctct gcattttact aaagatacca tttcctggtg cctggggtct
32751 agaggaccca gtgggtcatg tgaatgagga aggggctgag tgtgaagcca
32801 cagatgccct gtgtgtggtg acagctgtga ggtgcctgca gagtggcacc
32851 agcctacagg ctgcaggtgg cagtcttttgg ggaacatgag ctcagagctg
32901 ccacagcttc cggttttgca agacaatgct tccttctcaa actcccacac
32951 ctccccggat gttaccactc ctctcagcct gcggcacgtg cctggtttac
33001 aacaatattt tatggatgtc cttgggagct attaaagaat ttggtctgcc
33051 taggcccaag atatcatgct gacaatctgg aactttacct gaaatttccc
33101 aattgtaaaa ggttggttca aaacattatg aaatggccag gctccgtggc
33151 tcacatctgt attcccagca ctttgggagg cagaggaggg tggatcactt
33201 gagcccagga gttcaagagc agcctgggca atctagggag accccatct
33251 ctacaaactt catgccttgc tcttatgtgg ggaaaagagt gtaaagcctg
33301 tggagtgttt acaagtttac ataagtaaac tattgtacaa gttacggatg
33351 tatttttttt tttttttttt tttgagacgg agtctcgctc tgtcgcccag
33401 gctggagtgc agtggcggga tctcggctca ctgcaagctc cgcctccgg
33451 gttcacgcca ttctcctgcc tcagcctccc aagtagctgg gactacaggc
33501 gcccgccact acgcctggct aatttttgt atttttagta gagacggggt
33551 ttcaccgttt tagccgggat ggtctcgatc tcctgacctc gtgatccgcc
33601 cgcctcggcc tcccaaagtg ctgggattac aggcgtgagc caccgcgccc
33651 ggccgttacg gaggtatttt aatgctcctc acaactttcc agattcttca
33701 atttgcccat aaaatctggt ttctgagaaa gacactggaa gacactttcc
33751 tagcagaatc cagatcataa cctagcattc tctgcagctg gtggtgctat
33801 ggtctgtata gcaagaggcc acccagcaca gtagttatgc ccatggactc
33851 tggaagtgga cagcaccacc cttactggct gtcccagtga cctggggtca
33901 cttctctgtg ctttgctctt ctcatctcta acatagagat actaaaagaa
33951 cctgctgcct tggactgctg tggaggatta aatgcattca gatatgaaag
34001 tacttggaac agtgccttgc acacagcaag cattagcttt atattcatcc
34051 agaccatccc tttatattca tcaaaagcca acaagtgagg cctccagccc
34101 ggggccaaga gcctattgat gacaccaacc tcttgcctct ggggacgcag
34151 gccgtagctg ggccaaacct agaccaccc ttgccccaca tgagttacag
34201 gtggagaggt actcaaagag taaagaagag agacgcccat gctccggtc
34251 tactgagaac ttcctcttcc tctcgctaga ttaactatga agtcaggaag
34301 ctggtgaatg tctacagaaa cacaaagtag aaaacagatc tggtcccatt
34351 ccttcctaaa acattgaatg ccaacccatc ataagagctc agatatgtcc
34401 taagggccaa gttatgtttg aacctcagca tagcaatgtt atcaaaaaag
34451 cccgctgggt ctccacctct ccatatcagt attctgtctt aagctgaagt
34501 atcagtgact acttactgag cacccactac aatcagagca ctgttttaac
34551 ggctaggaat tgtaaagaaa acaatggtac ctggttctac agaagctcat
34601 tcattctcca gttaacaaa tatttattaa attctcactt tgtgccaggc
34651 actaaggaaa cagcagtgaa cacagcagat taaagccctg ccttctggtg
```

FIG. 5 CONT'D

```
34701 cacataatgt tgggagatag agatagataa taaacaaata gctaggtaaa
34751 ttaaatagta tgtcagttga taataagcaa tatggagaaa ataccataga
34801 gagggagtgc ctgaatggag gtgagtaatt cacaacagcc aggatgctga
34851 ctgcagactc agtgagcctg cctcagcgcc accatggtgg gtggggaagg
34901 gaataaggga ggcttcagca gaggctgggg tagtccatca ggccaaggag
34951 caaatgggaa aaaccaaaga gactcaggga ttcgcagccc atgagagcca
35001 tggggaagat gtcaagtgct cctgatagca tcacctgagt ccaagaaaga
35051 agctacctct tcactagcca caggcccatg cgcccaaggc tagcagagcc
35101 actggtgacc aggcaggaag ggaacatgga actggagtct agcaaatgcc
35151 agcccctgac accccaggag ccggcgtgaa gcttcataag gacctctccc
35201 tctagcttta agccactgac ccctctcccc gtacacctgg gccaccttga
35251 ggaaaggcat gatgtctgag agaagggaac actgcccaga ggggctgctt
35301 aactgatccg cctggatcat gccttaccta ggctagagca ttcatttctc
35351 ttgttgagag cacaggggaa aatcaaatca actataaatg aagaaattac
35401 attttctctg cctaggggga ggagacaggg aggaagaaaa agtggaaact
35451 gtgagtacag aaactatttt gaggagtttt gcatgaaaat gatccaggag
35501 agaaaactg atgacaagag agagagaaag agaattgacg cagtgatgtc
35551 tggaggagga gaaaggagca cttaagggc agagctgact tcagctgcaa
35601 gtaccaccaa ctgtcccagg ggagcacgag cagaggtggg ggtgtggtag
35651 ttatcttcag agaaacaggg tgcaaggaaa cctcccaaag gaaggggtgg
35701 tgggtgttgg gtctaaggag agaggagggg gtataaacca gcagcctggt
35751 ggtgggagag tgaatgaggt caggtgagag ttgggaaggc cgggggaacg
35801 aagcaccccg ctagaggttg tgctttcaag tgaaacaacg ccatgtgaga
35851 gcaggcaagg agtaggcagg gaattcggct tcaccagggt tgtggtgctc
35901 ttggtggatg gacgaggctg acaatggaga aaagagcaag ggagtcgagg
35951 gcgtctgtgt gggagtgatg gcgactgccc gtggaattta cgttgggtaa
36001 aggaagaaag tgaagacctg gggcaggcaa gggaccggga aaaggaagga
36051 ggagccagcg atggaggtcg cagtgggttg aaggattacc ggaactgagg
36101 tgctagggga agagagctaa aaagagagcg ggcggaggtc agaaagaggg
36151 ctgactgaag tggaggtgga ggaaggctgg caggcaaccg tgaggtgtaa
36201 gttccgtcga caggcgcggc tgagatcggg tggagagcaa ggtcataggt
36251 ggaaaggagg tcaacaaact agaggccaag gcattccaag actcggcatg
36301 ggtgtgaacg gccgcagatg cagtgcttca aagagagcgc aggcacctgt
36351 ccctcaggga ctacgggtga ccacggagga aagcgctagg gagggcggtt
36401 ttaggaccgc tggaaacagc agcgatgagg gaggcgacag gtgtccctcc
36451 tccaagctca cagtctgcat gtgagagaga actgcaggag aagcttgccc
36501 taggcaaagc caggtgtcag gtccagaatc gagactccag agaagaggtt
36551 gaggatttaa gccactgagg gggtggagct gggcagtgag taggacgtca
36601 ggcttgcaag ctctgggatt aggccgacca gagcccatat cccagtcccg
36651 cctcttactg cctgcttgat ctcaagcaag accgctttgt tcatgggcga
36701 aaggagcgcc ccgggccatg aggattaaat ggagagcaca gggccagatc
36751 catctaaatt ctcagtaagt gttagctatt gttattaaga ccacaccgaa
36801 cagactgaac atccgtttta gcccctttcc ccaatttcg ttctttccgg
36851 tgttgacaaa tcctctagtt ttttaagttt ataaaacatg ttgtacataa
36901 gaatgacata tcacatgtga aagtactcta gtgtccacgt aaatatttgt
36951 cttgttcttt ataataagta aacatgctca cggatccttg aaattatctg
37001 gtcactgccg ggcgcggtgg ctcacgcctg taatcccagc actttgggag
37051 gtcgaggcgg gtggaccacc tggggtcagg agttcgagac caggctggcc
37101 aacatggcga aaccctgact acacaaaaaa cacaaaattt agccgggct
37151 tgggcgctcc tgtgctccca gctactcagg aggctgaggt gggaggactg
37201 cttgagcctg ggaggtcgag gctgcagtga gctgtgatcg cgccacttaa
37251 actccagcct ggacgacagt gagaccctgt ctcaagaaga aaaaaagaaa
37301 gaaagaaaga aaaaagaaa aaaagaaat tatttggtca attatatggt
37351 cagctccctc caccactcgc gaatttacag aagaggagaa ctgggctggg
37401 cgagaccagg actagcccaa gattacacaa gttactcggt tgtagagcca
37451 ggattagaca ggagaggctc tagattctgg tctagactcc cctcctatta
37501 tttagcatta tggcttcctg aggattacca tgagccctcc tccaccgtca
37551 agcggcagct accagccacc agaccagatc ccttcgaagg tgcccggagt
```

```
37601 accagactga caaaagcgcc cgtacagtgc tcagtcctgt aaccaaagct
37651 gtctagggtg cagacatcgc tcaccggacc gggtagggct cgtgcgctaa
37701 gggcgccggg tattccagtt agtggagagg aagcgccct ggaactgcat
37751 gggcccggga gagggcgcgg gagcggagca gggccgggcc ggggcgggcc
37801 gcggccgtgg gcggagactg cgcgcagcta gctcgggagc gcctcggagc
37851 ccaccccgca gagccgcttc tcgcgccccg cagcgcagcg cagcgctccg
37901 ccgtctgacc tgccgcgccc gcagcgtgcg ggctgggaaa ggaggcgctc
37951 accgagaggg accacgcgcc aggctcccag cccgacccgg gacgcggcgg
38001 ccgcgcggag cacccatggg cagccctgg aacggcagcg acggccccga
38051 ggggcgcgg gagccgccgt ggcccgcgct ccgccttgc gacgagcgcc
38101 gctgctcgcc ctttcccctg ggggcgctgg tgccggtgac cgctgtgtgc
38151 ctgtgcctgt tcgtcgtcgg ggtgagcggc aacgtggtga ccgtgatgct
38201 gatcgggcgc taccgggaca tgcggaccac caccaacttg tacctgggca
38251 gcatggccgt gtccgaccta ctcatcctgc tcgggctgcc gttcgacctg
38301 taccgcctct ggcgctcgcg gccctgggtg ttcgggccgc tgctctgccg
38351 cctgtccctc tacgtgggcg agggctgcac ctacgccacg ctgctgcaca
38401 tgaccgcgct cagcgtcgag cgctacctgg ccatctgccg cccgctccgc
38451 gcccgcgtct tggtcacccg gcgccgcgtc cgcgcgctca tcgctgtgct
38501 ctgggccgtg gcgctgctct ctgccggtcc cttcttgttc ctggtgggcg
38551 tcgagcagga ccccggcatc tccgtagtcc cgggcctcaa tggcaccgcg
38601 cggatcgcct cctcgcctct cgcctcgtcg ccgcctctct ggctctcgcg
38651 ggcgccaccg ccgtccccgc cgtcggggcc cgagaccgcg gaggccgcgg
38701 cgctgttcag ccgcgaatgc cggccgagcc ccgcgcagct gggcgcgctg
38751 cgtgtcatgc tgtgggtcac caccgcctac ttcttcctgc cctttctgtg
38801 cctcagcatc ctctacgggc tcatcgggcg ggagctgtgg agcagccggc
38851 ggccgctgcg aggcccggcc gcctcggggc gggagagagg ccaccggcag
38901 accgtccgcg tcctgcgtaa gtggagccgc cgtggttcca agacgcctg
38951 cctgcagtcc gccccgccgg ggaccgcgca aacgctgggt cccctcccc
39001 tgctcgccca gctctgggcg ccgcttccag ctccctttcc tatttcgatt
39051 ccagcctcca cccgccggta cttcccatcc cccgagaaaa ccatgtcctg
39101 tcccccagga gctctggggg acccagggc gctttgaggg tgggatcccc
39151 ggatccgatt cagtaaccag cagtgctttt ccagagcctc tgagaccaga
39201 aaggagagtt ggtaattctt aatccaacca cctgttagat gccacagatg
39251 aggagtcctc acagtgctct tgagaagacg agggagattt cattaagcta
39301 aaatttttta tttaatgtta agtgatgctg aaggctaaag taaaccttgc
39351 tcgtatcaaa aagtaaagat tgtgcagacc tgttgtagaa ttcttttcaa
39401 cagagaacag aaaacttgtc tccgaagtgg gtttgtggaa ggaagcctgc
39451 caaggcggct tgttcagaga aattgctcct tctggtttat gtccagcctt
39501 gataacacat atgggagcct actatgcagt tttaaagcaa gtatccatgc
39551 agcctgcagc ctggtcattt tttctggggt gaggatctgc ctaggtagaa
39601 gttttctcta atttattttg ctgttacttg ttattgcaga tggttccttg
39651 tcggggtggg gggtttattt gcttcccaat gcttttgtta atcccggtgc
39701 tgtgtcttat gttgcagtgg tggtggttct ggcatttata atttgctggt
39751 tgcccttcca cgttggcaga atcatttaca taaacacgga agattcgcgg
39801 atgatgtact tctctcagta ctttaacatc gtcgctctgc aacttttcta
39851 tctgagcgca tctatcaacc caatcctcta caacctcatt tcaaagaagt
39901 acagagcggc ggcctttaaa ctgctgctcg caaggaagtc caggccgaga
39951 ggcttccaca gaagcaggga cactgcgggg gaagttgcag gggacactgg
40001 aggagacacg gtgggctaca ccgagacaag cgctaacgtg aagacgatgg
40051 gataaccagc acggccaagc caggctcctc ttgcagttct aagactttgg
40101 ggaaaacagg tgtgtagaga aataaagact gcaaatgagg aacagatcct
40151 gttaagaaga atggaaagag ggttgcagtt gtgccagttg gttaagaaat
40201 agaccgcatg atttatttaa ccaaggtatg aaatgtaact gcgccaacct
40251 ttctagtttc cttcccacgt acctcctaag gaaggtcgat tttaccatca
40301 tgaaatccca catctcaaag tgtgctcttg tgtgatggtt tcatgaagtc
40351 ctcattctcc tactcttcgg aaagatgatt gttcatttta cagttaaatg
40401 atacacaaag atgctgcccc aaaactgcca cctctgagat catgagtgta
40451 ttttatgttt tggatgtaaa tgtaacagta catctacaag gaaccaggat
```

FIG. 5 CONT'D

```
40501  aatgatagtt ttgatccaag aaatgattta atacctatgt atggctgcaa
40551  aaactttag aagtaaaagg aattctgggt agactccagt gttcaggggt
40601  cccacctctc tccagatcac agcaaatcat aaagtttagg caaaataata
40651  gcctctttca gaagtattaa gcaattgtgt tgcaacccac ttctccttga
40701  cactgcccat gggaccttcc cagtgccact ggccatgggg tggcaaactt
40751  tgggcatcaa catttgagag tagagagctc agcaggacat ggctttctcc
40801  agtgactaca aatgacgttt gtaaagagct atttaatatg ctttatctca
40851  cctcagcttg gtggggtgag tactgttgtc aacattcctg ttttggaagt
40901  gagtcttgga ttgcccaaac aggagctggt gagctggagt ctgaatccag
40951  tgtttaagtt gctcacccaa tcccaagcca agatgctgtc cttactgaaa
41001  aacgccagcc aatggattta gtcaagagtg aaagagaact cactggacat
41051  tctgatcaac aactctgtaa ctttgttttg ttttttagag tttaaaacac
41101  aaatatttt agagggttac tgctgtcact cagctccaaa gggcttcact
41151  tatgccacct tctgtatgaa tggcaccccc aagatgtggg cagggtacag
41201  ctttcacagt tgtacatggg acctttttg gggctttcag attgataaat
41251  tcaaacctaa attacaatag gatcttgatt tgtatgagga atttgtcctg
41301  agaccttcat gaatcttcac atctacaaat accagaaaaa tgacaaatgc
41351  tataacttca gagttataaa gacagataga cataaagtca cattgagact
41401  tggaggctag agaggcagct ccgttgattc actgacttga tgtctctgct
41451  tcacagccca cagtttgggt ggctttggta aatgtctaaa ttactttccg
41501  ccacaggcca ccatagtctc ttttgaatag ttaaaactac aaaagatgaa
41551  tacataaata acaagggtct gcccgacatg cattcaaagt tctgttgctt
41601  tctcattttc ttagccaaag ccctagctca gtccccagcc cggtccacaa
41651  ttggcacagg aatgaagtct ctcgtttgct ttttctccta gctagtggaa
41701  gaagcagatt gcagtcactt caggaagcat tccctaaact gtgttctgca
41751  gatttccagg gattattgga aaaaatggtt ctggggttaa atatggcagg
41801  aaaataccac attgtgttcc cctaccaca ccctaaacat ttcacacaca
41851  taacacaata tagcatgtca gaggctctga gaagttgtct caaccaacat
41901  ttccttgact tattttatca cagaaccaac tctccatctt ccctcccaag
41951  aacacttagt aaaatctcat ggagtgagaa atactttggg gagcactgat
42001  gtagggttc tgacagtgga ggtgtcagcc tggagcctcc ataactctct
42051  gcttggtagc actgagtaca gcagctgcca cagtccttct gctcatggga
42101  gctcctctct ggagcagtca ggagtggcca cctccctagg gaaagtcaca
42151  gcaaagaacc ttattaagat gtatataata ttttatttta tttttttaga
42201  gacaggatct caccctgttg cccaggctgg agtgcagtgg cacaatcata
42251  gctcactgta accttaaatt cctggattca aaccatcctc ccacctcagc
42301  ctccccagta ggcaggacta caggcacaca ccaccatgcc tggctaattt
42351  tttagttttt tgtaaagttg gggtcttgct gtgttgccca ggctggtctc
42401  aaactcctgg cctcaagcaa tcctcctgcc tcagcttccc aaagtgctgg
42451  gattacaggc atgagccacc acacctggct catgtataat attctaaatg
42501  tagaagcaaa gacctctctt ttgagctttc tcgttcagaa tctagaaaac
42551  aaggatttac atgacacttt cctgggactt aagcatgttt ccaggtgtgg
42601  gcatagggag gattatcctt cccttcccag atggtacctg agatggaggg
42651  cctgaaggcc atcccttcct tcaggattct tgtgtggtct cagcctacta
42701  gtggactgtg aaatcagtaa gtgtgtcata ttttttcttta atggaacagt
42751  gtggacaaga atagagtcca ttgtgtatca catgtactaa ggtaactatt
42801  gtgctgtgaa acttttgttt caattatgtt ttggttggtg tctttcccgg
42851  ttcacaaaat aaaatacatt ctaactgtgg gtcatggtgg aaaatgttta
42901  aaaagttgtt ctaagatcta aagttttttct ctgttcttac actgacaact
42951  ggctatgaaa agggaggcca agtcagcgaa tcactggagc aggagaatca
43001  ctgagctctg gtttccagtc cagggctccc tacccaccca acccagggtg
43051  gtaatcatgg aggctatggg ccagccactc cctccacccc aacagagacc
43101  cgtgctggca ttccagccac ttctctttga gcccctctc ccttctgcag
43151  gcagaaccac ttttgttagg tgagctgcca accttggaag agagtttgta
43201  tttcattcat tcccatggca aatatttacc aagcaactgc taagtgccag
43251  acgtgtataa tacaatacac tagaaaaact agtccatgtg atgatgtaaa
43301  aatcaatcaa ctttctaatg gcattctctg tttgaaatgt gtattgtgtc
43351  atctagacta acatggattc accatttaga tcagatggaa gtgcagaaca
```

FIG. 5 CONT'D

```
43401  tcaggtttgc actatctgtc tggatgttcc tcctcttttg tatgtgagac
43451  atttccactt ctgaaggaaa tgttcaaaga gctattgcac aacatccact
43501  gggatccaag agttccctgt gccaggttct caaagagaca caggcaacgt
43551  gctaatggtg ttgaaaattc aaacacgccc tctcctgacc ctttctactc
43601  atgtcataat gacatttgcc agtatatgga agcaaatttt agtggttgca
43651  caggtctagt gtgttttgtt ttgttttaga gacagggtct tcctctgtca
43701  cccaggctgg agtgcagtgg cttgatcaca gctcacttta gcctcaactt
43751  gctgggctca agcaatcctc ccacctcagc ctctcaagta gctaggacta
43801  taggcacaca tcatcttcac acctagctaa ttaaaaaaaa attttttta
43851  agagataggg ttttattatg ttgcccaggc tggtctccaa gtcctggcct
43901  caatcgatcc tcacacctca gcctcccagg gtactgggat tataggcata
43951  agccaccacg cccagcttag gtttagtgtt ttaaaagtgg ctttacttaa
44001  acatagatgg gatgcaatat ttaattatga gcccaatttc taaggattcc
44051  aaaccctatt acagagcccc tagtcttcta cgaggagcct ttgaattcag
44101  cgtttcctct tctgagcgca caggcacag gctccaaagg aatgctctgt
44151  ggaagtcact caacctgtcc ctggtgtaca ctatgtctct ggtgtacact
44201  acagaggagg ggactcgacc ggccccctta ggaaaacact acacactttt
44251  taaatagtgc acacctgtgt actaagggtt aaaaggcttt ttattccca
44301  cactaattct ctgggtcagt ggttctcaaa cttcagcctg catcagaatc
44351  acctggagga cgtggtaaga cacagattgc tgggcttccc ccagagggtt
44401  ttggagttag taggtctggg gtggggccca agaatctgta tttctattga
44451  attcccaggt attgctggtt tatgtcccag gtgaaacaca gcgggatggc
44501  ataagatttc atcacactac tcagggcacg ctcgactgaa aacctaacaa
44551  ctgtttaatt ctgaaatttt ccatttaata gttttggacc atggttgacc
44601  acaggtaact gaaacctcag aaagcgaaac tatggataag ggggactact
44651  ttgtggttcc aaagaagcca tccagctgga aaagttctgt tgttgcattt
44701  tccacaggct cctgcaaata ggtcctgatg gtcaaatact ctttttttt
44751  tttttttttt ttttgatata gggtctcact ctgtcaccca tgctggagtg
44801  cagtggcaca atcacggctc actgcagcct cagcctcccg gactcagatg
44851  atcctctcac ctcagcctcc tgagtagctg ggactacagg tgcacaccac
44901  cacacccaga taattttta attttttgt agagacaagg tttcaccatg
44951  ttgctcagac tattctcaaa ctcctaagct caagcaatct gccctccttg
45001  gcctcccaaa atgttgggat tataggcgtg agccaccatg cctcagcact
45051  taaatacttt taagaaatgt tgcaatacta tataaactct ttttggccat
45101  acagcttttt ttttcctctc atatattaac attccccaaa atactccacc
45151  ttgaaattct agagagaagt ttgggtatga agtcagggct caccataaag
45201  atttgggagg caacagcatg gaaatgatca tcttatccag tgcctcaaaa
45251  actttttgctt gcatcagaaa cactagaggg cttcttaaaa cacggatttc
45301  tgggcccact ccagaagttc tgattctgta agtctgagaa tttgcatttc
45351  tgtgtagttt gcaggtggtg ctgctgctgc aactccagga tcacactttg
45401  agaaccactg atttaagtga tagaaataga tggccccgac taggagaaag
45451  cttaccaaga tcaaagcaga ggtgcaggga tgcactctaa tgatccccac
45501  gctggctgga agtcaccaaa gcaggcagaa gagcagaaaa gaaaaagcat
45551  gtgatgcatg tgatacaacc caaaggaaga gcgtttcaca gagggtcgga
45601  ggtcaagggg tcacgcacca cagggaacac aaagagaatg aagtagggtt
45651  gccagacgaa attcagagcc tgaaactaaa tttgaatttc tgataaacaa
45701  catatatttt atgtataagt ttaaatatta ttagcatgac acactaaggg
45751  ccaggcgtgg tggcaaacac cgggagtccc agcactttg gaggccgagg
45801  caggagggtt acttgagacc aataattcaa caccagcctg gcaatatagc
45851  aagatctcat ttccacaaaa aaatgcattt cttcattagc tgggcatggt
45901  ggcgtgcccc tgttgtccta gttacttgaa aggctgaggt gggaggatag
45951  ctttgagctca ggagtttgag actgcagtga gctctgatca cgctaccgca
46001  ctttaaaaat atagcatacc tattacttac attttaaaat catttattat
46051  ttatctgaaa tccacattta aatgggcact ctattttat ttttaaatct
46101  ggtaacccta ggatactggc aatggaaaga ccacagagtc tggcaaaagg
46151  aaggaatcta gaaagtgcct ttcaagagag tgctggggca ggagccggaa
46201  gatggtaagt tgaaaggaaa tggccactga gcaacagtgg gttagatggt
46251  cccagccttg gggccctctt tgtgcaggga gctcagcagc tgattaagca
```

```
46301 actttgccgc tagtcctgta ctgtactgac ttgtaccccc acccaagagc
46351 cagcctctcc tgctgtggct tgtatcccag caccccagtt aggaaagcac
46401 ctaccgccct tgtgttaggc atctgcactg cacagtcagt aattattttg
46451 attttttaa atcacaaaac tgaagaatgt gtctgattca gaacttcctg
46501 gaatataatg tgtcatgaca atctgtcaaa ctgaagaagc ttcgtttgta
46551 tctaacctgt tcctaggtgt ttatgtacac ttaggcattt ttttaaggct
46601 taattttctc tttctgcaaa aggggttgaa tgaaataaaa ttttgttaaa
46651 tgaataatta atttacaatg aggggtggtt cttttcttct tttttgagac
46701 agggtctcac tctgtctccc aggctggaga gcagtggcgt gatcagagct
46751 cacttgcagc ctccacctcc caggctcatg caatcctccc acctcagcct
46801 cccaagtagc ttggactata ggcacacacc accacaccca gctaattttt
46851 gaattttttg tagagactga gtctcaccat gttgcccaag ctggtcttga
46901 actcctgggc tcaagtaatc cgcctgcctc agcctcccaa agtgctggga
46951 ttctaggcat gagccactgc tccaagctgg gtggttcttc ttctaaaaaa
47001 aatgtaactc tgtgtgatga ctgagaccat aaaggataat gaagtaatat
47051 ttaaatctgt gtaaagcaac tagcattgtg ccgggtagta atagatttga
47101 taaatactac ttaaatgtaa atggaggata gcaacatttt ggacagggaa
47151 aaatatcgat ttcttaaaaa ctaagttcat tgcagtatta taatacatta
47201 taatggagtg tttagttata taactattgc aatgtacgta taacatataa
47251 taatacaagg tacttggtat gccatctgga atgcagtaat tctcagtaaa
47301 tgtgagctag cattttttgtc ctcagttcat atcctattaa ctatcacttg
47351 ttgggtctt ttgtttgttt ttaaaaacat gaaacaaaag tactgaacat
47401 ttattttcta aaaatccaac aactcataag aggcatattc acttcattac
47451 ttagcttttt aagggacacc attggcattt tactcccaaa ggatgctatc
47501 tttcactgaa agtcttcagt tattttttgt atttataata accccattca
47551 tatgattctg agttatcctc cagcatgcat ctttaaaaac tggattcttg
47601 tgcctaatgc aagcatctgg ctttcttaaa taaagatgaa aatggccagg
47651 tgcaatggat tgagccttat agtccgagct acgcaagagg ctgaggtggg
47701 gactactctc ttaagcccag gggttgaaac ctgcagtgag ctatgatcga
47751 gccaccgcac tccagcctag gcaacagagc aagacctcac ctctaaaaat
47801 aaataaaat aaaaatgcat ttcataaaca catttcccag tagcagttcc
47851 taagttggat tctttaaatg ttcctttact aatttccata tacattttga
47901 tttccttcga caaggaaaaa atacaaagta tattttatgt ttaagttgtt
47951 gggctatata taaaaatgaa taggcctgta atcccagcac tttgggaggc
48001 agaggtgggt ggatcacttg aggtcaggag tttgagaaca gcctggccaa
48051 catggtgaaa ccctgtctct actaaaaata caaaaaaaaa aaaaaaacca
48101 actagctgga cgtggtggca catccctgta atctcagcta ctcgggaggc
48151 tgaggcatga gaatcacttg aacacaggag gtagaggttg cagtgagccg
48201 ggattgtgcc attgcactcc agcctgggca acagagtgag actgtctcaa
48251 aataataata ataataatag gaccaggacc cttaacctca agattctgtg
48301 acttgtcagg atgggggaaa aaaagtatgt aaataagtat agatgtgatt
48351 aaataagttt taataaagag cagggggaatt tagagaaact gtaccaagca
48401 ttaaatgtat tacttttagt aaccagaaat tccttccatg gatgtagtta
48451 agatttata gtatttggga ggccaaggca ggaggaccat ttgaagccag
48501 gagttcaaga ccagcctggg caacatagca agaccctgtc tctacaaaaa
48551 aaactaaaaa gttagccagg tgtgggagtg cacacctgta gtcccaagct
48601 gctagagagg ctgaggcagg agaatcactt gagcccagga gttcaaggct
48651 gcagtgagtt atgcttgcac cactgcactc tagcctgggt gacagagtga
48701 gaccctgtct caaaaaataa taataataaa ataaaagatg ttatagtgat
48751 tgttggctca aaccatgcaa actctgctga acatagttta ttaacaataa
48801 ctctccatct gaggagtcat taaatctttc tgagctcagt ttgctcacat
48851 gtaaagtaag aaggttagaa ccaaattatt tgtcatctct tctacataaa
48901 ttattctgtg aatccctcac ttccctcagc cttgtaggtt tgggtatatt
48951 ttagaaattt gctagaatta ggccaggtac agtagctctc acctgtaatc
49001 ccaacacttt gggaagccaa aacaggagga tcgcttaagc ccaggagttc
49051 aagaccagcc taggcaacat gacgaaatct catctctaca aaaactacaa
49101 aaacatccag gtgtggcggt gcatgtctgt agtcccagct actcgggagg
49151 ctgaggtggg aggatcactt gagcccagga ggtcaaggct gcagtgagct
```

```
49201 gtgattgtac cactgcactc cagcctgggt aagagagcaa gaccctgcct
49251 caaaaaaaaa aaaaaaaaaa aagtactaga attaaacaaa agagacttgt
49301 tgcacctaaa atagctttt ataaagcttt caagtccatg aggttgattt
49351 tcatttaaaa tacagttgct aacaagttgg gtcatctgct gtgcccacca
49401 atagcatgtt aaaagcattc aataggatgg cacaagagag gaagggctat
49451 tagcaacaga acagtgatgt tgggagatgg ggtaactaga ctgacaggaa
49501 agaatgagga aaagtgggac atccaatggt gaggtccatc acactgatcc
49551 tgagccccccg acggcaacac caaactatgc tcagcacttt ttaaagaaat
49601 tatttaaact gacaaataaa aattgtatat gtttattgta tgcaacatga
49651 tgttttgata gatatatgtt gtatacattg tggaatggct aaatcaagct
49701 aattagcata tctgatacct cacatacttt tttggtaaga atatttaaaa
49751 tctactgtct tcgcaatttt tagatataca atttattttt gttaaccata
49801 gtcaccatga tgtacaatag atttgctttc ttttcttttc ttgtttgaca
49851 cagggtcttg ttctgtcgcc caggatggag tgcagtggca tgatcatggc
49901 tcaatgcagc ctcgacttca ggggctcaag tgatcctgct gcctcagcct
49951 cctgagtaac tgtgactaca ggtgtgcgcc accatacctg actaattttt
50001 aaatttttt tgtagagata gcgtatcact ttgttgccca ttctggcccc
50051 aagcaatcct cctgtctcga cctcacaaaa tgctgggatt acaggcatgt
50101 ggcaccacac tcagccatga ttgcttgaat ttattccctc tgactaactg
50151 aaattttgaa ccctttgacc aacacctccc caatctctcc ctgcttccgt
50201 ttcctggtaa ctgttttact ctctgctttt tatgagttca attttttag
50251 attccacata tgagtgagat tatgtggtat ttgcctttct gtgcctggct
50301 tatttcccat aacataatgt ccttcaagtt catctgtgtt gttgcaaatg
50351 gcaggatttc cttctgtttt aaggctgaat agtattccaa tgtatgcata
50401 tatgtatgta tgtatgtata aaccacattt tcctatacac tcatccattg
50451 atgggcacct aggttgattc catatcttgg ctattgactt gttcatttt
50501 aagaatcagt ctttctgccc acaatgtgtg gtgtcttccg tacacacatg
50551 gtgggggctg atcagggagt agtggtgtgg tcaggtatat ttgtgtccac
50601 caggtttcct tccaaaatga atgtccaggc tactgggctt tagagaaat
50651 agtcccaagg tatctacgca ctctgctgtt cttggaaagt caggatttgt
50701 cgtaagcaca tctgtcgcat tggaagcatc tgaagaaaac tgttctttt
50751 cttaacggtc attgcaactg cttttaggat tccacagtgt taaatctgcc
50801 cttttcttttag agcagtcaag aaagatgtaa taactgaagg aaatgggcct
50851 tcctccactg ataggcatga tgcttttgaa atttaagtgg agctcttgca
50901 tttgtttttt gtatggacgg tataaggaat ggcacaaacg ctagatggaa
50951 tagctttata gctgttgagc atttgtgctc ttttgtgcat caatagattt
51001 ctatttcatt ggtttcattt gttcttaaaa atgccctatt tttatttat
51051 ttatttattt ttttgagatg gagtctcgct ctgtcaccag gctagagtgc
51101 attggcacga tctcggctca ctgcaacctc tgcctcctgg gttcaagcaa
51151 ttctcctgct tcagcctcct gagtagctgg gactacaggc acctgccacc
51201 aagcctggct aattttgta ttttagtag agattgggtt tcaccatgtt
51251 ggctaggatg gtctcaatct cttgacctca tgatccaccc gcctcaaaaa
51301 atgccctatc ttaacaagag ccttgggggg gaaaattcca gtggcaaact
51351 tctggcatct tcttgacagg cagcagctta actacagtta tcacattcac
51401 aaatgaagtg gtaaaaaata ttgaatttta ttatacttt tggtttgagg
51451 aagccactaa tgtggccact aaacatgatg ttcaaatgaa accttctggg
51501 aagtttttca gggattacca ggataaccta gaatctcaac tagcctttga
51551 cattattaga aacagtgtcc caatggtaga gcacattatt cagaaactta
51601 gatttctca gatcagcacc tcaaagtact tatactaaga cacaggacat
51651 ctccagctca acatgtcaga gtaacacact gctgacatgt acagagtgac
51701 tcaccaatct agacgcactt ctatggagct ccattgctgg aagatcaagt
51751 ggaaatacac acggaaaggc aaagaacttc tatctgttca caatttatga
51801 tgctcgctat ctgcctgaca tctatgtctc tttcttaatg tttacatatc
51851 atttcaggtc ctgtgttccc aggatggaga ctgagagtga gcacagatgg
51901 atgtaagcat cacaaaatat gcccaaaaaa acactgacca gaggtcaggt
51951 catgtcactt ggttaacata actcttaata caaaacatgg tttgcattta
52001 atgatagaca cataaagcaa actctataca aatgagtcag agcctccaaa
52051 agtaactcgg aaattactga caataccgta gataatattt taagatgctt
```

FIG. 5 CONT'D

```
52101  tgtttttcac  tattaggaag  taaaactatg  atttgcatta  ggccacttag
52151  tcactaaagg  taaatttggc  tacaggcctc  ccaccaaatc  cattagccat
52201  ctatgtccta  catgttgaat  aatcacagcc  tgaacttgca  tgctttgaaa
52251  acttctctgt  ctccaagaag  atggtattca  aagtgtcaag  tttcatttct
52301  gtgcgatgcc  cgccagtggc  gtgatgaagg  gattaaagtc  attttgggaa
52351  ttacatttat  aatctaccaa  tctaatgacc  aggatttgag  ttatcagctt
52401  ttggaagaaa  taaatgttga  ggaagtgagg  gagggagaaa  aaaatttata
52451  caaaagaacg  aagcttccaa  ctcaaataca  ttgtgtttta  agtgcactat
52501  taaaactatt  ccataaggaa  tagtttagga  agttaccaga  aagtgataga
52551  aactgtgtgc  tcacctgaac  aggatttcag  ggtaaacttt  gtcttcatca
52601  aagaatggac  agtagccagg  tccagtggct  caggctgtaa  tccagcactt
52651  tgagaggtgg  agttgggaag  atcccttgag  gcccggagtt  acagaccagc
52701  ctggtcaata  tagtgggacc  ccatctctta  aaaaaaaat   aaagaaagag
52751  aaaggaagga  ggggagggga  gtggagggga  ggggagggga  ggcgaaaggg
52801  aaggggaag   tgtggaggga  tggaggggga  aggggagggg  agggaggaag
52851  gaagaaagga  aggagttaca  gttacagttt  gaatggaggg  atgcctcact
52901  gttgccccac  atgtgttgct  ggggcttgca  cccctttgtt  gtatctctac
52951  cctaactggg  ccatcagctt  tttagcggac  cacacatgaa  ccctctgttt
53001  tacaagcaag  acagaacatg  agttcacaga  cactgacaac  tgatttgtct
53051  ctctttggtt  attctttggt  ttttttcat   tgcctcatct  tgatttatat
53101  gcataagcat  cttgatttat  ttttgcaaaa  aaaaacttcc  aaaaataaaa
53151  gttttgtagt  ttacctagga  ataatacaca  aatattgca   ttttgtgag
53201  gaaaagctat  ttgtatagtt  tatttcaatc  taataatatt  tgaaatttgt
53251  ttgaaaagca  aaataaaaag  aagcactgca  gagtaactgt  gtgattgcct
53301  gatgggttgt  cctgcctgct  acacagacaa  aaccaattca  ctgggaacac
53351  ggtactatag  taaagaataa  gtttaattaa  ctaaggccag  ccaagtggaa
53401  gaactggagt  tattactaaa  atcagttttg  ctgagaactc  agaagccaga
53451  gttttatgg   ataatttggt  gggcagggg   ctagggaatg  gatgctgctg
53501  cttggttggg  gatgaaatca  tagggtgtg   gaaaacagtc  ttcatgcatt
53551  gagtcggcct  ctgggtgtgc  gccacaggac  cagctgagtt  atgcatcatg
53601  ggtccgggta  ggatcagttg  gttaccagaa  tgcaaaagtc  tgaaaaatac
53651  atcaaaagat  caatcttaga  ttctacaata  gtgatgttat  ctataggagc
53701  aatgactcct  gggcagtaag  agagtatgaa  aactatgccc  atatttagca
53751  gaattcaggc  cgtcccataa  tcctaacctc  gtggcctttc  attagactta
53801  caaaggcagt  tttagttcct  ggacaaggag  agggtcattt  tagggagaga
53851  ctactgcttt  caagttaaac  tataaactaa  attcttccca  tggttagctt
53901  ggcctatgac  caggaatgag  tgaggacagc  cagcctgtga  acctagaagc
53951  aagacggggt  cagccatgct  agattttct   gactgtcata  atctttgcaa
54001  aggcagtttc  aactgtccag  attatttagg  tcactcaggt  gaaatgtata
54051  tgatgcacat  gtaaactaac  aacattcagc  ttttgtcata  tgagtgacta
54101  tgtaaatgtg  aataaattac  attttagctg  ttgataagac  atatgtgcat
54151  tattgcataa  gtatgcaaat  actaactccc  tcttcttcct  caaggcactt
54201  tgaactaaag  agtcctcaaa  tctgaacatt  cttttttatta aaataaattt
54251  gtgctccaaa  aagcatataa  agcaatttat  aaaagcatct  aaaataaaac
54301  acacatgaag  taaatgggga  aagtagaaac  taacaaaaaa  ttaggatagg
54351  caaaataaga  ttataccagg  aggaaaatga  ggacataaaa  ttcatatcct
54401  ggtgtatggt  taagaagttt  acgtgattca  tgggagacag  gagaatcgat
54451  ccttcaagta  ttccaagatg  acatcttaaa  agctagaaaa  ctatgtcctc
54501  aacaacaatc  tttaaggcaa  gcatagtaat  gaatgtccta  gagctttttc
54551  ttataaagcc  aatgagaaaa  attgtcccac  atttggaaaa  tgattaaata
54601  gtgactactt  aaattttttt  gctatgcatt  ttttttttt   tttgagatag
54651  agtcttgctc  tgtcacccag  gctagagtgc  agtgacacaa  tctcggctca
54701  ctgcaacctc  cacttcctag  gttcaagcaa  ttctcctgcc  tcagtctccc
54751  aagtagctgt  gattacaagt  gtatgatacc  accacaccgg  ctaattttag
54801  tatttagtag  agatagggtt  ttgccatgtt  agccaggctg  gtctcaaact
54851  cctgacttcg  tgatccacct  gccttggctt  cccaaagtgg  tgggattaca
54901  ggcgtgagcc  attgtgccca  gtcacatttt  ctagtattag  aaaataacat
54951  gactgcttga  ataaaagcag  gacattgtta  aagggaactc  tcatttgata
```

```
55001 ttcgggggga atgcaagttt gttgtcacat tttttaaatt aatagcacac
55051 aattcataga agcatagccc tctaaaaaga gattaccttg ctgaaactga
55101 aaaagtgtta ggattttata gcctttttaa ataagtaaat taaccccaaa
55151 caagatacca ctatatacct attacaatgg ccaaattcca gaacactgac
55201 aataacaaat gcaggtgagg aagtggagca accagagctc tcatttgtca
55251 atgaaaagag tcaaattcta aaaaaatctt tgaagagatt tactttgagc
55301 taaatatgag agaccaatga cccgtgacac agccctcagg agatcctgag
55351 aacatgtgtc caaggtggtc agggtacaag ttggttttat acaatttagg
55401 gagatataag acatcaatta atacatgtaa gatgtatact ggttaggtct
55451 ggaaaggcag gaaaaccgga agtggggact tccaggtcat agttggattc
55501 acaggttttc tgactggcaa ttgtttgaaa gagttattat ctaaagacct
55551 ggaatcaata gaaaggaatg tctgggttaa gataggcagt tgtagagacc
55601 aaagttttat catgcaggcg aagcctccag gtagcaggct tcagagagaa
55651 tagattgtaa aggtttctta tcagacttaa agactctatt ctatcagtaa
55701 ttccaaaatg gaggagggca taatgaggca ggtccagctc ctccttccca
55751 tcatggcctg aaagttgacc tgaactagtt tttcaggtta actttggaat
55801 gcccttggtc gagaggaggg gtccaatcag atggttgggg ggcttagaat
55851 tttatttttg gtttatacat tcatttctgt tagaaaggaa aaaaaggtac
55901 agttacttg gaagatagtt tggcagtttc ttacaaaact aaacatactc
55951 ttaccatatg atctaacaaa catactcctt ggtatttacc caaaggagtt
56001 gaaaatatgt ccacagaaaa acctgcacat gggtgtttgc agaagcttct
56051 tttttttttt ttttaatttt tatcattgtc caaacttgga agcaaccaag
56101 atgttgttcg gtaagtgaat agataaataa ctatgctaca accaagcaat
56151 ggaatattat ttggcactaa aaataaatga gctatcaagc ccgaaaagat
56201 atggaggaaa cttaaataat gcatattgct aagagagaag ccagtctgaa
56251 aagactactg ttctgcaatg ggcaggtcta tggaaatcta cccctaaagt
56301 ctgcggaagc taagaggcca agaaagaggc tgacacattt ggtttctcag
56351 gaaaaaacaa acaaacaaac aaacaaaac atttaatagg gacttaggaa
56401 gagaagccac aatgtcctgg gcagctgcca gacaaggtgt tggattccca
56451 cactatgacc cccacagacc cagggcttcc atgtcatagg gaaggaatgt
56501 gtaggacaat tatagggaaa ggcaagatgc tatgtgaatc tgcctagagc
56551 agaatttatg gtcaagggag ttttgaccta agggcaggat ttacagtaag
56601 tacaagctct tacacaagga acagtagata aaatggaaga tagcagcctt
56651 ccctaaattg aggttaatca agaagtcaac agggcggatt ggcatccaag
56701 atggagttgc gttagcctcc acaactacat acaatgattc caactatatg
56751 acattctaga aaaggcaaaa ctatggagac agtaaaaaag aagactagtg
56801 ttgccaggag ttagggtgca gggatgaata aagcaaagca cggaggattt
56851 ttaaggcagt gaaactactc tgtatgatat actacaatgg tggacacatg
56901 tccctacaca tttgcccaaa cccagagaat gtacaacacc aagagtgaat
56951 tccaatgtaa actgtggact ttgggtgatg atgacatgtc agtgtaggtt
57001 catcaactgt aacaaatgca ccactctggt ggggatgtt aatagttggg
57051 gaggctgtgc atgtgtgtgg caggggccat atgggaaatc tctatttcc
57101 accccatttt gctgtgaacc taaaactgct ctaaaaaaat aaaatctttt
57151 ttaaaaagtt aacccaaaag tatatggttt tattgcccta agaaagtta
57201 accaggcata ttgtacctaa cttagctatt ttagagaatc cttttctctt
57251 caagtattta aatcctgttc ctcaaataca ctctgaacta ggtctcattg
57301 ctgccaccaa cggttcactc attttaggag ttaaatgagg gggagttaat
57351 tgagttttat tggaaaacgg ccacactcag tcgttttcat atcatctatg
57401 gctgcttttg tagcagaatg gaatagttgt gacacagact aaatggtctg
57451 aaaaacctaa aatatttgct atctgggcct ttccaaaaaa gtttgtaaac
57501 tccgggccaa ataaaacttt gacacttgct cgaatctggt atgaaaattt
57551 tgcttgtagc atcagttaac atcagcagat gatatgatac caaaaagtac
57601 ttggtatcat cagttaacat cagcagatga tacgatacca aaaagtactt
57651 ggtatcagtt gcttttggta aaagcaattc tacagagggc caaaatactt
57701 tagctaaaaa ccactgattc agaatctcta aggctgggac ccagaaatct
57751 gggttttaac atagtctctg agggactctt atgcatactc cagttggaga
57801 atcgctggag cccactggcc tagcccagtg gtggatgtac agattctgac
57851 tcagaaagtc tgaagtgcag cccaagattc tgcttttctc acaagctccc
```

FIG. 5 CONT'D

```
57901 acatgatggc gatgttgctg gtctgagggc cttagtttcc tcacctgcgt
57951 aatggagatg ataaaaatct atttcatagg gttgttgtgg gtagtaaatg
58001 aagtcataat gtccatttat atcctgcccc caccccttc aagctatgtc
58051 tattggggca agttaccgaa tgtcttggtt cctataagtg gagctaaata
58101 atattgccca catcacaagg ttgctggaag gagcaaatga gataataaac
58151 ataaagtacc tagaacagag cctggaacac tgtaaaggct caataatgta
58201 agatactatt attactatta tcattatcgt tacatagggt gtctgatcat
58251 agcagatatt ccatcagtgt tagtttcctc cctactccct ctcctatcca
58301 tcctctcatc cctaccctc cctctagtgt cttctgttga tttctttttt
58351 attttgttt agagatgctg tctcactctg ttgcccaggc tggcatacag
58401 tggtgcaatc atagctcact gcagcctcaa actcttgggc tcaagcgatc
58451 ctctcacctt agcctctgga gtggctgtgg ctacaggtgc acattaccac
58501 aactggctaa ttttaaaaag tgttttgtag agatggagtc tcgctatgtt
58551 gcccaggctg gtcttgaact cctggcctca agtgattctc tggctttggc
58601 ctcccaaagg gatgggacta tgggcacaag ccactgcacc cagccctcct
58651 tctgttgatt tctaatgtgt ctaattagat aacttctata ggaatgctga
58701 ttcagaaata cctgaaccca ggtggccta cctgacagtc cagaggtgcc
58751 acacaaacag ggacccaaaa tgagcttgga cattgactgt gctgcccagg
58801 cccctctgcc caccccctct caggcaggct tttggtagag agtttgggag
58851 aacaagggaa agtgggcttg ccagtccttc ccacctcagg ggagcaccat
58901 ttccagggct gcctgaacat tcttactctg cagcacatta atctacgtgg
58951 caccaagttt atttttctga gaagattatt tgggacaata tatggaaaat
59001 ctgagaagtc atttctcttt ggcagcactg ccctccataa caaagcacat
59051 attcctgaag ggcatctgga tttttgtttca ggtttctttt tgcttcctca
59101 gggtttaagt gctgccagga atggccttct aagaattgct tagcaaacct
59151 taatctccag actcagggtg gtggggataa tcacatttt tgcccgaaat
59201 gaccaaattg aaaccatccc cacagggttg acaagaatgg catgctgggt
59251 tctggacaga aatatagtta taattaagaa tgaatcagcc gggcgcggtg
59301 gctcacgcct gtaatcctag cactttggga ggccaaggcc ggcagagtgc
59351 ctgagctcag gagttcgaga ccagcctagg caacacggtg aaacccccatc
59401 tctgctaaaa tacaaaagaa attagctggg catggcagca tgtgcctgta
59451 gtcccagcta ctcgggaggc tgaggcagga gaaatgcttg aacctgggag
59501 gcagaggttg cagtgagccg agatcgtgcc actgcactcc agcctggggc
59551 gacagagcaa gactccgtat ctacaaaaaa aaaaagaact aatcagacag
59601 gcacggtagc tcacacgtct aatcccagca ctttgggagg ccaaggtggg
59651 tggatcgctt gagttcagga gttcgagacc agcctggcca acacggtaaa
59701 acctggtctc tactaaaaat acaaaaatta gccaggcttg gtggcatgtg
59751 tctgtaatcc ttgctattca ggaggcagag gcatgagaat cacttgaacc
59801 taggaggcag aggttgcatt gagccagtat tgtgccacta cactccagcc
59851 tacctgggca acagaatgag actctgtctt aaaaaaaaaa aaaaaagaa
59901 ctaatcaggc cacaattcag cacacttcct tgttgccaaa agtcactaga
59951 tcctgaccat ttgcatcccc attgttccta aagataggat ttctgacatt
60001 aagattataa tgatggagac aggaggcaga gaaattctag gcagacaggg
60051 gcaggtccct ggcaaagtcc catcctcaag ccaaaaagcc tgagactgca
60101 gcccaaagtg agaacttaca tccctgttct cccgctcaaa tgttgccttt
60151 tccaaaacca cccatggccc gccctgcccc ctatcctgtg cttataaaaa
60201 cccagactc agccggcaaa aaggagaagc agctggacat cagagactat
60251 ggctcaacgt ctgagagaag tggcttgact tcagagagac agcttgacag
60301 cataacttca gagaagaatc tggccagaga cagccggact tcaggggaag
60351 attaccttcc cacccatcc ccttttcagc tcccttcct gctgagggcc
60401 acttttatca gcgataaaat cctgttttta ccatctttca attccttcgt
60451 ccaaactcat ttctcctgga tgccaaacaa gagcctagga gccacaagtg
60501 cagatgcaaa aggctgtcac actggccctt tgccctcact ggtggaagac
60551 agctccctca catgaaaagg cagagggagg ctctgcagag ctgctaacac
60601 ttaagctgtc tgcaaatggc agagctaaaa gaccactgta acactccctc
60651 tggggcttca ggggttgcag gaaccccacc agatactgcc ttgggggcat
60701 gcatggagtt tgctcctgct ggtgctcaaa agtgctcacc tggctcctgc
60751 acctgctcac ctgtgtgctc cctcccataa ggggtggaga gcagtgagtc
```

```
60801 cgaatgagtg gagttcactc ctgctggtga cgaagtggcc agctgattcc
60851 agtggttgtg tactccagtt cctgccttat ttgctcatgc gctccctccc
60901 gcaaggagtt gagagctgtg ggctgagtaa atggggcacc cctattgcga
60951 gtcctgcaaa gcggtcaggg aaatatccta cttcaataag actgtttaaa
61001 aatggatttg catccctgtt gttcctatag agatgatctc tgacggaatc
61051 ataaggcttt tgtttaagga ttgcttaaga tgttctcaga tccaaatttc
61101 agcgaccagt ttggagaccc tcacagaaga acgggatgag cataagaaca
61151 cagcttcttc atctccctgt cccatgactt caccctgtgc tcttcgacca
61201 gtgaacactc tccacacttg ggcccactcc aaaaccctaa agactgtagc
61251 cccaaactcc tcagacagat ggatttaaga ttccctccca tctcctcctt
61301 tggtgaccct ataggtaaat gctttatctg ctaaaaccca gtgtctctgg
61351 cactggtcat ggagtgcctt ctcacaagag caaaattgag tgtaaggtac
61401 attttcttcc acaagccagg tattccataa gcaccaccag catcagcaga
61451 tccagctaca gattcagtga ctatgatcaa ctccacagac catcagcttg
61501 ctttgttgag aggattctgt cctaataaac acactgctaa gactaacatt
61551 cccaatccac aggacctaga ataaaagaaa attcaggcta cttagagaat
61601 aggtaaatga aagatgaaaa agggagggac aatcaacagt attgagcacc
61651 tgtgctttgc caagcaccat actacttggg atcatgtagc ccttcatgaa
61701 aatttgtgat aaatgtttta ccatcatcct ttccttcctt ctttccctgg
61751 gctattcctt cctcccttcc ttcttccctg agtaagtcag tcaaaaaggc
61801 atttgataac ctcccctccc ctccccttca agggagaaga ggctattaca
61851 gcagaggaag aggaaggggc tggaaagcca aagaagcaac tagcatgcta
61901 ggaaggtgag tcacatacag gggaactgag ggtggaaaaa agaaagaaag
61951 gacagaggct gctcctttag cctggatccc agaccaatt cacaggagca
62001 gcagcatgta acatgagtaa aaattaacct ttgtgggggc aagccactga
62051 gatttcatgg tcatttgtgt gaaggaaaa tgaatcttgg ggccccaaaa
62101 tcactaagct aaagggaaaa gtcaagctgg gaactgctta ggacaaacct
62151 gactcccttc tattcaagtc atccctctgc tcactgagat aaatgtatat
62201 ctgattgcct cctttagaaa gggtaatcag aagctcaaaa gaatgctagc
62251 atttgtttct tatctaccta agacctggaa gcccctccc aacttcgaga
62301 tgtcccacct ttccagacca aaccaatgtt catcttacat atgttgatgg
62351 atgtttcata tctccctaaa atgtacaaaa ccaagctgtg ctctgaccac
62401 cttgggcaca tgtcgtcaag acctcctgag gctgtcacag gcgcatatcc
62451 ttaactttgg caaaataaac tttctaaatt aactgagacc cgtcttagat
62501 tttgggggtt cacatttgtt acccacagca agccgggtct aagccaactg
62551 atacagtaac tggtaaataa cttctgttct tagagtgtga atacagcttg
62601 tctctctcat atcaaagccc atggtccttc cacttgatat atagaattgt
62651 ttattgattt aaaaaccatt ttattgatta aactggcctt tgtagaactc
62701 agctgctctg agcttgtcca cttctcagca cttagggaaa atttcatttt
62751 ataatccttt ttagtcctct tattcctctg cagcagaaca attattccac
62801 caatactgtg gaaaagttag cctagtctga aaaatatttc agctacaaat
62851 acctaaaaat gcaggataaa atatggctga gctagcaaga aagtaagaga
62901 aatagtccaa gtatttaaac tgctctgaaa tactaaagga ctgaaaatgg
62951 aatgagacca ggagtccaaa gagaggttaa tgagcaataa agctaatgat
63001 tgtttgaagg gcagggcaga tctagactgc tggggattaa agatacacac
63051 acaaacacac atataacata tataggtgtg tatgtatata tatatacata
63101 tagttatttt gagagtttaa gacttaaaga aagttgcaaa aataatacag
63151 agttcctgtg ttaccccttca cccagcttct gcaataataa tgtcttacct
63201 attcacagca ctttggtaaa agcaggaaac tgatactggt aaaatactgt
63251 taatacaggt atagatctta tttgtgtttt actagttttg aatgtaccac
63301 tttgcatttt tggtgtatag ctctatgaat tttatcacat gtatagatat
63351 gagtaactgt caacacaaag aaactctgtc gtgttacctc ttaacagtca
63401 gacccttgtc ccaaccataa catttggcaa tcatggattt gttcttcaat
63451 gctataattt ttctttggct atgagaatgg tatctagatg gaatcataca
63501 gtatacaaca ctttaagact ggcttttaaa aactcaccac aatgcccttg
63551 agattcattc aagttgtacg tatcaatagc tcattacttt ttatggctga
63601 gtagtgtccc atggcatgga tatactccag tttgcttttct attcattcac
63651 taaggactgt ttggcttgtt tacagttttt ttgttttttt gttttttgaga
```

FIG. 5 CONT'D

```
63701 tggagtctca ctctgtcgcc caggctggag tgcagtggtg caatcttggc
63751 tcactgcaac ctctgcctcc cgggttcaag tgattctcct gcctaagcct
63801 cctgagtagg tgggactaca ggtacatgcc accacgcctg gctaattttt
63851 tgtattttta gtagagacgg ggtttcgcca tgttgcccag gctgatctca
63901 aactcctgac ctcatgatcc gcccgccttg gcctcccaaa gtgctgggat
63951 tacaggtgtg agccaccatg cctggcctgt tttcagtttt tgactattaa
64001 aaataaagcc accatgacat tcatgtacag agttttgttt gaacataagt
64051 tttggtttgt ctaggataaa tacccaggag tgtgattgct gggtgatatg
64101 ataagcatat gtgcaacttt ataagaaact gtcaaactgt tttctagagt
64151 ggttatgcca ttttatagtc ctaccagcaa tgtttgagag atccggttgc
64201 tctgcatcct cactagcatt tagtgctgtc agtacttgtt attttagcca
64251 tttaaatagg tgtgtagtag aatctcattg tggttttaat atacatttcc
64301 ctaatggcca atgacactga acactgtttt acatgtttat ttgccatctg
64351 tatatcttct ttggtgaaat gactattcaa gtctttgatc catttttctaa
64401 ctggactgtt tacttactct gagtttatat ggttctttat atattctgga
64451 tatgagtcct ttgttggata catgctttgc aaatattttc tcctagtcca
64501 tggcctgtct ttaaaccttá gtgttaattg ccatgaaggc actgtcaaca
64551 aagtctacac ttcaggaaag gtgcagaatg gagttctctg gatatagtca
64601 aatcacctga agagctttac cctcagaaca ggcgaactag aaaaaattct
64651 acaagccaaa gaaataaata gcaagctgaa agatagatct gaagaaatta
64701 gccagaatgt ggctcagaga aacaaaatga tgcaatattt taaaaataat
64751 aatttagaac ctcagaaggt ttaacctatg cctaatagga attccaggag
64801 gagagtctag agtaatgttg tccaatacag tagtagccaa tagccacatg
64851 tcactactta aaatgtaaat taattaaaac taaatgaagt taaaaatgca
64901 gttccttggt tgtactggcc acatttcaga tgctcaatag ccacatgtgg
64951 ctggtggcta ccatattgga cagtgcagat atagaatact acaggaaatc
65001 ctactggaca gtgctgatct aggtcataaa acaagtctga acaaatttca
65051 aagaactggt atgatacaga tgttttgtgg aaataaacta gacattagaa
65101 attaaaaaca aaataactcc tactgcctcc tctcaccttt ttccccatta
65151 caattccacc tcttaatgtc ttcatgttct tgatgagaag cagaacgtcc
65201 ctactgtgtt ccatggcacc aagttcccca gaacccgcca gtctctgatg
65251 acagaacatc ctggaccgcc cagctcccaca ccccaaccca agaagttctc
65301 taaaacactg accatgacag cctgggtag gtttccactt taacattctg
65351 accaaaattc tcaactcgat gcagtcagag tctgcgcaac ctgggacctc
65401 gagccaagaa atcctcaagt gaccttactt ggcaaaacca acaaaacaac
65451 caaatacagg tctcaagcga tttacagctc ggtgcttaac tcggtcaccg
65501 gccgaggggc agccctctgg cgccaaagcc ccgcctctct atgacgtcac
65551 acgaggagcc ctgaagtggc ggtcaagctt gaggcgtcat ctggctgcgc
65601 ctagtgggcc gttgccttac agttgctgag aggaggcgag aggcggggc
65651 gctagggccg agatcatgtc tgactgggag aggtttcctt ggcagcagag
65701 gacgctaggt ttgggatgaa agaagctggg cagatgcaaa atctggagag
65751 cgcgagggcc gggcggtcag tcagcaccca gactggcagc atgaccggtg
65801 agtgtccggg accctgctcc cgccacccta cctttcgctc tgccctgtgc
65851 gtctcccgtc attgaactcc agattccttg tctgagcctc tttgcctccc
65901 ctgctgcttt tggatgtctc ctgcccgccc tctgcgtgtc ccctccgcgg
65951 tcgccaggac caatcggctc ggtcgcactg gcttttgaag tctcgctttt
66001 taccctgtt agctacttct cacaggacct agagctgggg cctctgaggt
66051 caaagagcct gaacatttcc aaacggcgct tttgccttga tttccaaatt
66101 aaccgcacgt gacgctttcc tgtatttcga ctgctttacc gtcgaaggtc
66151 agcgcatttt tcgggttgtg ttctaatcgc tttccttta gcaacgcccc
66201 atcacagtcc aaagaaaagc ttgcaccacg acgacgtcag atgcgaagac
66251 ttttcacagc ttgctttggg ttgtccccct cagctatgtg tattagctgt
66301 accgttttt cctgcagggt gagggctgga gaaagaaggc tcaactttt
66351 aagtggagaa ggaggtagcc acgactaagg ctgaagcgtc tactgctaag
66401 ataccctctga ctctcttgtc ccctatcttt ttctgtgcct cttgcgaaag
66451 cagctgggct taggctgcag cacctaagtg gcattgagat tggctcccctt
66501 tttcaccatt agtaacaaag tttaaagtgt ttgtcgtctc ttttgtaggt
66551 cagataccaa ggctttctaa agtcaacctt ttcactctgc tcagcctctg
```

FIG. 5 CONT'D

```
66601 gatggagctc tttccagcag aagcccagcg gcaaaaatct caggtataat
66651 ttgtttcata gttttttccc ttagaaaagc agtggtttaa aatctgagtt
66701 tattgctcca gtttctgtca tacctaaaac caaacttaac aaggcttaag
66751 atttaaaaaa tatctttatt gattaacatg cactttata attcccagcc
66801 gtaataagtc atcttccatt ctaaaaatac tttctgagaa taccatgttt
66851 atcgggtact aatggtattc atatgtcagt tcggctaata agattattgt
66901 ctataccaca taatttcccc caattatata tactgttggt gttttatcta
66951 ggtagtttac tcctctgcca cagaaatata taaattgcct ggagatagag
67001 accatgtctt atttaccta gcatataccc tttagagtct agcattatat
67051 gagtgctaat tgattaatgt tggatggaag tagtctcttt ttggatcttg
67101 aaagacagga tcaaaacaga ttagaaatgg gctgtgtgca gtggctcacg
67151 cctgtaatcc tagcactttg tgaggctgag gtgggtggat cacctgaggt
67201 caggagttca aaaccagcct gggcaacata gtgaaacccc atctctatta
67251 aacatacaaa aattagccag gagtggtggt atccgcctgt agtcccagtt
67301 acgcgggagg ctgaggcatg agaatcgctt gaacgaatcg ttggaggtta
67351 cagtgagctg agattgcacc actgcactcc agcctgggtg acagagcaag
67401 actccatctc aaaaaaaaaa tcagaaatgt atagtaagaa taatcataaa
67451 agccaatata ttggaattgg aagtataaac atcctgcgtc ttttctttct
67501 cctacccttg gggcaacaag gggctaggtt ctcatttttcc tccatgcttg
67551 gaatggcatg atgctaggtt ctcatcattt ctgtttgata attttggaag
67601 cttagggtgt tggcattaat ttttataggg ggccacggcc attggaaaat
67651 agtattaggt taagttgagc atttaagact tttttaaaa cagaggtaaa
67701 atgaggggg tggggcagaa aattacacat ggcttctcac cactctaaca
67751 acattactgt taatattttg gtgcttccaa tcttaagcat gaggtttttt
67801 atttttactc ttacaaagtt gtagttatat tctgcatgta ctcgctgagg
67851 tttccaactt gcccataatt ctgctgaaag gttgctttag attttccaga
67901 gaaagactat aaatccttaa attcccacag tactcttagg agaccaccta
67951 ctcttttcat tttactgtgg atgaggtttt gtgcttggca ctggagacac
68001 aaagcagaaa aaacatggtc tttattttct aatgagtaga aacactaggc
68051 atttaaacaa ttaaaacaga attggtggag tgagtacata gtataagcag
68101 agatgttggc aagactggga gccaggctct atatggggaa gtgaaggaag
68151 gattcacaga gaaggtcgta tttgcactga gacatgaagg attagtggac
68201 ttttgcccaa gccaaggaac tctacatgga aaagcttgga gcaatgagag
68251 aatttgtggt cctcaggcca gaaagtgaag ttaggtagag ggaagagact
68301 ggaaaggagc ttgacaatgt agacaggaat catatcataa aaagcattgt
68351 atgccttgca aaggagttta gattttatct tatcaatata ggaattgcat
68401 tgaggaattt taacaggatg tgaggatatt cgcttctcat aataaaatga
68451 tatctcttgg tgtagtttcc tcccccaatt cctatgtgaa gtgttttata
68501 gatagtaaaa cattatttaa aatattatac atcgttattc catatttctc
68551 accctcatcc ccccactctg gctctacatg ttattaacgg ctgagaaagc
68601 tcttcatttc cttcattaat tttgaaattc ctttattcct tctacttgtt
68651 aatagtttag tattattttta tgaaagtaga tttccaagct gttagggatt
68701 ttatgtagtg ttgtgttttt tttgttttgt tttgttttgt tttcagataa
68751 aatttatttt gaagagccag attagaaaca aatatttaga ggtttaagac
68801 ttttaggccg ggtgcagtgg ctcatgcctg taatcccagc actttgggag
68851 gccgaggcag gcagatcaca aggtcaagag atcgagacca tcttggccaa
68901 catggtgaaa ccccgtctct gccaaaaata caaaagtag ctgggcgtgg
68951 tggtgcgtgc ctgtagtccc agctacttag gaggctgagg caggagaaac
69001 acttgaaccc aggaggcaga gattgcattg agctgagatc acgccactgc
69051 actccagcct ggcgacagaa aaaaaagaa aaaaaaga aaaaaaacg
69101 tataaaaact ggacatatta gagattgaat acaaatttg aaaaggcgtt
69151 ctttttttg taaatatcca gatgtgatct cgttttagtt ctgtttttt
69201 atatacacac cacatcctgt gctgaaatta agttttttt ttcaacaggc
69251 acaagttgta tttaattagt gagaaatgac atttatgttt ctattaggaa
69301 ggaattgatt ggccaactaa ttgttgaagt ttatttgcaa ataatacaca
69351 ccctactgtt tcctcatact atatagagaa agctgtggat ctgagaaaac
69401 tgagatgaag ctttcagtta gcattttgtt aaaaaaaata ctaccaagga
69451 aatttcaaaa ctatattagc aacaaaattt tatacaactt tatatcatgt
```

FIG. 5 CONT'D

```
69501 ttaacaaaag atcaaggtta tgactctcat tttctcccaa gccaacaact
69551 cttaagtttt cctggcatct cattccttca tctggtgggc accatggaag
69601 ttttctaaat gaaataaat aagtcttttg tttcagatat tttatttggg
69651 atcttattta gaaatctgac tcatacgcat gtctatttaa ggcttttaaa
69701 tggaaagtta taacacatag aaatgagtac agaaggcatc aaaacaaaga
69751 acatccatgt cttcagaaag ccaggcaacc tggaactagg attgacttgg
69801 ctatatgaaa ggttatcact cttagctcct ggtcctggag catgcccagc
69851 tcctattcac tgcattggtg tctttccagc tgtgctccca tacccatgtg
69901 tcctaggact acaaccctct caccatggtc ttgggtaggc ctttacttct
69951 gttcttacct acagggcttg ggactccaag gcacttgggg agggagagcc
70001 tcaggattac tctggcagtg atctgggtga agaggctttt tgcatgttaa
70051 cttgggaact tgactatcat ttttaacatt gtttatatga gaaaaatgtg
70101 ttttaaattc cgaaaaggga gatttaccaa gtatttagaa catgattgta
70151 ggttgtcaat tacttgtata tttaatgtca ataaagcaga agtatataat
70201 ttcattagtt cttctgatat catggccatt gcaaaaaagc aagaccaatg
70251 atagtgtggg ggaagaatac agaatgaaag ggagcatatt gtactccact
70301 tttatagtgt tatttattgt acaaacatta tcattgaaac tgaatttata
70351 gctgcaacat ttttaaaaac tattttttc tcttggattt ccttttttgta
70401 ctagttaata tccacataat tttgcaggta gttgcagtca tagcaggaac
70451 acaattttgt atttgacagt tttggtactg ttacagggtt gataagttat
70501 taattttaaa ttatacagta agaatacatc taaatttcat atgcatgtag
70551 tatatgctgc cattgtgttt atacttgtgg aaatattaaa tttctcaaaa
70601 tgttgcccaa ttttgtgcct aatatttctt taccatttac tatagtatat
70651 tttttccagt attatttgca catggtattc ttagagttga gtacaaactt
70701 tttccaatta agagaaaaaa agtcttcttt aagctaaagt aataagattg
70751 tttcacttaa attctttagt ctgcttttgt tgtacagagt aaatcacaga
70801 aataccaaga tgcaattaga catgtaattg tattggaaat actgcttttg
70851 atactttacc aacatttgtc ttactaaaag tatttttatg agttaccaaa
70901 gtaatatatg tttgttattt taaaatgga cagaagaaaa attttatcat
70951 aattccacct cctagagact aattactttt taaaaattgt ttctcagtct
71001 tttttctctt actttcttta cttacatgag atcatttaac tctggatcct
71051 acccttttca cttaacataa gaaaatactt atgctgtaat gctagtataa
71101 acattggagc agcaccttag tctagtaatt tagagtagcc agtggtttta
71151 cagccagcct gcctgggttc agactctggc tccgcctctt actagttgta
71201 taactttggg taactctacc tctctgtgtc agcttcctca tctgtaaaat
71251 gaaatgttac tagtatatac tacatgaggc ttttatgaga aatgaatgag
71301 ttaatatttg taaaggtctt agtgcctggc acatgttagg tactatgtgt
71351 ttgttgttgt tgttgttgtc tccttattta tttatttgtt tatgtattta
71401 ttttaataga gatgtggtct tgccatgttg cccagactgg tcgctaactc
71451 ctgggctcaa gcagtccacc cgcctcagcc tcccgaagtg gtaggattac
71501 aggcatgagc caccgcacct agcctcctaa ctctttccat tgtgtcttct
71551 ggtacccttat gctaaaggcc ctcactgtac ttttccagaa cagaagcaat
71601 gtggcataat ggttaagaca atggatcttg ggctggatct ggcatatcca
71651 cttaattacc tgtgtgacca tggttgaatt atttaatctc tctcagccac
71701 aattttcctca tttgtacaat gggaataata ggagctactt tataaagtta
71751 taaggattaa atgagataat ttagggcctg gtacatgata aacatgcagt
71801 agatgttagg tactgttatt atcatcactc atatatataa ttattaccac
71851 tactagcacc cacatcctta ccgttttcc actgatacca tcacttcctc
71901 tacttcctgt tctgtctgaa cagaaacctc attcccagaa catgggtttt
71951 cttataaact tcttttgat ggttctttct tttctagcat ccagcacttg
72001 tttcataaga ctagcaggtc aacatttaca aagtttccca ttcctactt
72051 aaaactttat caatgtatta actatcccac cctttttttt ttttttttga
72101 aacagagtct tgctgtgttg cccaggctgg agtgcagtgg cgtgatctcg
72151 gctcactgca acctccatct cccggttca agcaattctc ctgcctcagc
72201 ctcccgagta gctgggacta caggtgcgca ccaccatgcc cagctaattt
72251 ttgtattttt agtagagaca gggtttcact atgttggcca ggctggtctc
72301 gaactcttga cctcgtgatc tgtccgcctt agcctcccaa agtgctggga
72351 ttacaggtgt gagccactgc acctggctat ctcacctatt ttggagctca
```

FIG. 5 CONT'D

```
72401 cagaattctg tgtcactttc tttgtcttaa tcaacttact tcatagtcac
72451 tttcctgttt tcataaatca taagccctgt gagagctgca tcttgagcaa
72501 ctaggctgtc atgtagcaag ggttcaataa gtatttgttg aactaataaa
72551 tgaaggactt tggtccctgc ctcaaaactt tctttctact tcaagttttc
72601 acttttcccc tcatggatat acctgtattc gttttctatt gctgctataa
72651 cagatgacca caaagttggt ggcttaaaac aacacaaatt tattatacag
72701 ttctgtaggt aagaggtctg aaatgagcct tactgggcta aaatcaaagt
72751 gttggcagag ccaaattccc ttcagacact ctacgggagg acctttcctt
72801 gccttttcta cctgtggaga ttgtctgttt tccttggctc atgggcccct
72851 tccatcttca aagccagcaa tggccagtca ggtctttcat gttgcatcgc
72901 tgactctccc acacccctct tttactcata atgacccttg tgataacatc
72951 gggccaatca gataatcaag gataatctcc ctatgtcaag gtaggtggtt
73001 agtgcctcag ttccagctgc aaactgattc ctccttgcca tgtaacaaaa
73051 catagtcaca ggctccagtg actgggacaa ggaatctct ggcggggcat
73101 tatcctgcct accacaatcc cgatctaata cctttgctac atagttcctt
73151 atcttctcaa ttccagttaa tttacctcta ttccacttta gtcattcatg
73201 gccacacttt ggacttttcc attactcaaa actgccacaa ttctgaaacc
73251 ataaacttca gaattttatt ttctcattac aatttccaat ccttctatgt
73301 tttgggaaag tacatagggg atagattata aaggtttatt tactaggtaa
73351 agtagtatga acttgatcca aacaaagtgg gaagtcaatg tagagtttca
73401 tcatggaaaa aaaaatggtc aaagccaagg aagccagcct ttaaatatgg
73451 gaatattgaa ttagtcatat gtcttatgtg ctaatctttt ttttttcctta
73501 atctgatttt tattagaaaa atgaagaggg aaagcatgga cccttaggag
73551 ataatgaaga gaggaccaga gtatctactg acaaaagaca ggtaaatttt
73601 tatgatttca catatatatg ctcataataa caaagcaaaa ggaatagtat
73651 aaagtagaat aaaagtgcct ccatttctac tatcaaggga gtttttaaaa
73701 tactcttcta aaaatggtct gtatatttac aagactatat gtcactcctt
73751 tttttttaaaa aaaaaagtac agatgggatt attctatgct acatcctaca
73801 tcttgcttta aaaaaaaaaa aactcttgat ggttcatata gatgtgttaa
73851 gaaatactct cccttagttc tctcacactc ccacacacct tgctgggtat
73901 gccaagaatg caaggcccta accattttt acctgggtca tttctcagag
73951 ttgtgtttgc agtgatcaac cctgaaggtt gaggtaatat ctccctccag
74001 gacaaaaagc aatctggctt actttctgct gtgaaacagt aggaccctca
74051 agctcagtgt tcctctccta taacactacc caccctgtgt ccaggcagcc
74101 atctgtgccc atttgtatta cccctcatgg ggcttgaggg caggaaacag
74151 aaatgatgct catactgact gctgtgctgc aaataataaa gttcattgtt
74201 tctaacccag aagtttcatg ttttctgcta atatccatga aacagtaaca
74251 ggttaactta ttagttggta agtagggtaa aatcaaagtg cagacttgaa
74301 agatgaacct tgttctttt aatattgtat agtatttcct tgttacttta
74351 ttcctttgag ttttccagag gttccgattc attggatgca gagtggagac
74401 taagcatgta tgttttgaag agttaccttg atgattccga tgtatattcc
74451 tagagatttc ctaattcatt ctgagagtga gcccagtagg aatatagaaa
74501 taatttgtct cagaatattt acatgttttc ataataagaa aggccaaggg
74551 aaaaaaaata gtgaatcacc atttaagtca atgtactagt ccatatacaa
74601 aacagactgt acccttttgc ccatgtttta gtgtaaaact ctgtgactag
74651 gatcaaacag atgacttgcc aaaatgttag cgaagtgagg caaaatcaaa
74701 ttcagagcag cgattcactg aaaagattca gtcctctggg agttgtggta
74751 aatggaagtg ccaaaatgga atgcaacttg agcttttatt tgtttattg
74801 agtttgggat ggaaaaatct tgtctcaaa cttggtattt tggccttacc
74851 tagatgcaaa atgaaaaaat acatattttc tgaggtaaaa aggactctag
74901 acaaaaaagt gataaataaa ctcgacccaa aagattgttc taataacaaa
74951 taagttgatg agtgtgcttc tcacttgata ggaacaattt ttttttttat
75001 gttttattct ggctttattt ctgtctgttt aactaggaaa atctaaagct
75051 gaaatcattc ccttgcagcc acttccactg gttacgttgg ttcaatttaa
75101 caataggagc tctgtcaaga tcttttgatg aggcagcatt acttctttc
75151 caagatgata cgtattggcc gggcacggtg gctcacgcct gtaatcccag
75201 cactttggga ggccgaggcg gcggatcac gagatccaga gatcgagacc
75251 atcctggcta acatggtgaa acccatctc tactaaaaat gcaaaaaatt
```

```
75301  agccgggcgt ggtggcagct actcagctac tccacgggct gaggcaggag
75351  aatggcatga acccgggagg cggagcttgc agtgagccga gatagtgcca
75401  ctgcactcca gcctgggcga cagagtgaga ctgtctcaaa tcaatcaatc
75451  aatcaatcaa tcagtccagc ctgggcgaca gagtgagact ctgtctcaaa
75501  taaataaata aacaaactta ttgaaagtat tcagaaatca ataataatat
75551  atgcttcgca tttgaggagc ataaaactca agaaattttg gtagggaggg
75601  gaaagtgttc acaaattcaa ggtcaattta aagcttattt taaaagccaa
75651  tatagatagg tttttcatat tttatataca tccttaggta catattttgt
75701  aaagcagaga ttttgtatt cctttataaa tgtccttcta gtttaggaga
75751  tggttggtta actcagaaat ggaattccat aaaatcttct ctgttccttc
75801  tttttagat agtttacaaa ttattctccg taatctcaaa cattcatact
75851  caaaaccgaa actgaaactt gactagttaa tatcgctttg gtctgatcct
75901  taaagtgatt tcagatatgc tgtattgggg gataagtata gggttaaatc
75951  cctttggaag gggatgggga atagggacac cctctcctta gcccaagctc
76001  ccctcatgta acagtcagtc ccaagcccaa ggatcaggtt tacattcctt
76051  acttcagagg cttttgctgt gaaaacagca tagactgttt tgtgccttat
76101  gcagaactga cttttttttt taaccttagt ctgttttatc tgatattgtt
76151  ataccagctt tgattagtat ttgtttaagt tgagaaactt taggttcaat
76201  agtaacacaa aaccttcact caaagagatc cactggaagt gcttagaacc
76251  ccagtcagta accagtctgc agggcttaat tcaggctcag ccagtccctg
76301  ctctgtggaa tattgctaag gtagctcaag ctcactactc tgacatcaag
76351  ttctctcatc cttttttgaca cttgatggta tgtcttcctt cttttttgttt
76401  ttataactta cctatagtag gaggtgggac ctaactatag tagtctagac
76451  tgccatagtg ctaaaaattg atacagccag tagtttctca aaagaaattg
76501  agaattatct tttctttggt caatatctaa aatatttag aatttaagat
76551  gacctctgct ttagttctgc cttttaccat ctgtgggtct ttcagaaagt
76601  catgtaaact ttctgggctt tacttatcca tgtgtaaaat cagggcttta
76651  tattctttat taccatctag aagcttaata ctaaatggta ctacacttaa
76701  tcctataaga aacaagtcaa attgatctag ttcttgccct ttactaggtt
76751  ataatgtatc taatctttca ctagaacaaa ttaatgataa ttacatgctt
76801  aattgtttga ttagtagagc ctaggtttag aaaatttctg gcctaaagtc
76851  aacactaaag tttcagaagc ttttttggatc taatgagaaa tgtgctttgt
76901  acaaactctg tttagataaa gaattaaaca aaacttccat ttttattaat
76951  aattcaagta taatccataa tatgattatt ggtgttata actaataagt
77001  tgttattta tatcttaatg taggtaaaga gaactggtct tgtggtggtg
77051  aaaaacatga aaattgttgg tctccactgt tctagtgaag atttacatgc
77101  cgggcagatt gctcttatta aacatgggtc aaggctgaaa aactgtgatc
77151  tttattttc cagaaaacca tgttctgctt gtttgaaaat gattgtaaat
77201  ggtaagtgca gaaaagggtt tgttggggat taagagtatt tatctgggat
77251  gggcgtggtg gtttatgcct gtcatcccag cactttggga ggacaaggca
77301  ggaggatcgc ctgagcccag gagttcacaa atagcctgtg caacataggg
77351  agacctcatc actacaaaaa ataagttagc taggcatggt gatgcacgcc
77401  tgtagtcccc actacttgag ataatgaggt gggaggattg cttgagccca
77451  ggatgtcaag gatacaatga cccgtgattg cgccactgca ctctaagctg
77501  ggtgacagaa caagaccttg tctccagaaa aaaaaaaacg aagaaaggag
77551  cgtttctctg agagcagtca gtgggaacac atttgctaaa taccacagag
77601  ataatttaga aatatatatc tgaaagtcag gtgctatggc ttgcacctgt
77651  aatcccagct actcagaagg ctgaggcagg agaattgctc aagcccggga
77701  gttcaaggct gtagtgagct atgattgctc cactgcactc cagcctgagt
77751  gacagagcaa gaccctgtct ctaaaaaata aaataaaaaa tatgtaaata
77801  tatatctgaa gacagtttga tacattataa gagtaagcat cagaaaacat
77851  ggattctggt ctcattcatg tctactaacc tattaaatga ccctcagtgt
77901  atgagtagac taatgctaac tgctataaca aaacaaaatt tcagtgactt
77951  atgtactaga tatttatcac ctgtataata gtccagcaca tgtgttgcta
78001  aacagcaggc agctttctcc atttggttga ttcctgggct aggcatcttc
78051  tgtctcattg ctgttgtcac ctctagggct ttgagtcctc tgtatccaga
78101  ggcagactga gaaagaatga gtagagaggg tgaacctgct tcttaaaaac
78151  cctgacctgg aagtcacata catcatttct gttctcatcc attgtgggaa
```

```
78201 ctgttgttcc cactgggcag ctgtctttca gtgactacta tacactttgg
78251 aaggaggaac acaaattttt aatgtatagc catccgtcca caccaggcta
78301 ttcactaaac ctccttgtgc ttatgattct gttttgcacc caggtatatg
78351 ccgatcattc tttcatttaa aaaatatgca tcttgttgca taggcatcat
78401 ggtagatcaa aaaacaaaaa aaactaatgt ggttcctaat ctttactctc
78451 gaggtgttat ttgggggcca aaataacaat ttaatatgat gcattatcta
78501 gtaccaaatc agcgatacag gttgtaagtg atatttggtc tcagaggaga
78551 aatagtgatc cctgcagatt tccatattat gaaaggctgg ggcttaagct
78601 tgatcttgat gcgtcatagg tagaggaaga ggaacacatt cctggtcagg
78651 gggaacagtg tatatggagt catcaagttg taagaagcaa agttctaggg
78701 gtcagtattt gaaatggaga attattcttg gagaacagtg gcagatgaat
78751 tatagtgata gtggagaact ttgaagaact gtagagcctt tggactttat
78801 cttataaaac agagttccta ggcctgttgt gagaaagagc tatttttatt
78851 tacagcaaag ccttaagagt aatgatcaga tctatgtcaa ggtcagtgcc
78901 ttgagctata aatggcagaa cttctagaag aaatggatca tgtggctaga
78951 aacctctcgg cctgcaacaa gtatttcgag caggtaggta tctgtggtag
79001 tgattggatt ctatattctc aactgcagtt accaatacat tgagaagata
79051 ggtatgaaag tggtggtggc atttttttca ccttttccca attaaccagg
79101 cagattggac atgcatttca tcactcatgt tcaactgacc tacagttcct
79151 gtttgtaggt aatgtggaga cattgaagat tcttgagaaa gatgtaacgt
79201 gattgaaatt tttgttgtta ttgctgttat tgaattggag cagggagaga
79251 ttagagattg ggagcttgat tagtagacta ttgcattagg caaggtccaa
79301 atagggttca gatgatgaca ttgatacaga aatgaaagaa tgtgaaagaa
79351 ccaaaacatt tgttggctga tctgttccag atcaagggag aaaaatgaat
79401 aaaagatagt tgtgctttgt gctgagctaa ctgtgctgaa agcagtctta
79451 atagcctcgg agccacaaat tagagggaag aataggagag tgcaggtaac
79501 tcatcactgc ttgatgtctt aagacatttc atcctgacaa aaaagataat
79551 gaagtatgga aagtcaggaa ggacctacag tggaaatgct tgtgtattgg
79601 tgttggacaa tatataaaca aaattgctat gttagattag gcttatgtat
79651 tatatttagt tatcttagga aggggcatg gttgaacccc atgctatagc
79701 tagattactt tagttagaat tgctattacc tcagttataa ggcaaagatt
79751 gttgtagcac agtggttctc caagtgtggt ctgtggactc ctgatggtcc
79801 acgaggtcaa tgttattttc ataataatac taccttcagg ttgggcatgg
79851 tggctcatgc ctctagtccc aacattttgt gaggctgagg caagtggatt
79901 gcttgagccc aggagtttga gaccagtcag ggcaatatgg agaaacccca
79951 tatctactaa aaatagaaaa attagctagg cgtggtggtg catgcctgta
80001 gtcccagcta ctcgggaggc tgaggtggga ggaccactgg agcctaggat
80051 gcaaaggttg cggtgagctg tgatcgtgcc tcaccaatgc actccagcct
80101 gggccacaga gtgagaccct gtcccaaaaa gcaaaaacaa aaacactaca
80151 ttcatactaa tggtaccaaa acaatgatag gtaaaactac tgtttccgta
80201 tctttatttt tatttattt ttttttgaga cagagtctcg ctctgtcacc
80251 caggctggag tgcagtggca caatttcagc tcattgcaac ccccgcctcc
80301 caggttcaag cgattcccct gcctcagcct cctgagtagc tgggattaca
80351 agcgtgcacc agcatgcccg gctaattttt gtatttttag tagagacaag
80401 gcttcaccat gttggtcagg ctgatctcga acttctgact catgatctgc
80451 ccacctcagc ctccgaaagt gctgggatta caggcgtgaa ccactgcacc
80501 cagcctgttt ccatatcatt aagacagtgg tgccaaactg ccctggtagt
80551 cgtcatactc ttcactgcac tcagagggaa aaaagaaaac cagttttaca
80601 taagaaggtc cttgatgaaa cagtaaaaag tatcaatttt attaaatccc
80651 aacttgagtc tgcatctttt taatattctg tgtgaggaaa caggaggtgg
80701 gtataaagtg cttttgctac agacctaagg tatgaagatg gctttaagga
80751 aaaccatgta tgtgattgtt tgagttgcag actgacttat ctacttttt
80801 aatggaacat catgaactga caatggttag ttagacttgg atatttggca
80851 gatattttct tgaaaatata gtgaacctgt cactttcaga taaacaactg
80901 acagtatttg ttgccagtga taaaatttga gctatcaagt gaaaattaga
80951 attttggaaa actcatattc tctattatga gcctgacagc atctcaccac
81001 ttagactctt tgatgggat tggtggtgat attaatgaac gggattttt
81051 ttaatattgt aaaatcagta aatcattgtt ttccggatga ccaatgcaca
```

FIG. 5 CONT'D

```
81101 atgctacaaa atcatgcatg agtaaaagcc attctaagtg caagacagac
81151 caacggactt taacgtaaca gttcaaaaag tttgttgata tggtttcaga
81201 ttctacattg taactaacct ttaagaaact atcccttgtc aaatttttat
81251 gtagtgccaa agaagaaatat tcacaagtat ctgaaatggc tgttaaaata
81301 ctccttttcc aaccacatat ctatatgagg ccagataatt ttcgtatact
81351 tcaatgaaaa caacatattg caacagattg aaaacagaag caaatttgag
81401 catccagttg tcttctatta agccaaattt ttttttttac aaagcaagtt
81451 actttattag aattttaaac aatgtataag tgatggaatc attctaacaa
81501 cacatctatt cactgcttac aattccaacc aatttcagtt ctctgatatc
81551 taatgacaag agcgaagacc tgttaaagtt ccttccacca gtaaaaccca
81601 cagctcaaag ttgtgggagt gattaactga gccataggcc ttcattcaca
81651 tgtttaccac attaaaatac cacacagtgt tttcttataa ggtcaaccac
81701 ctgggaacta attaacatta gcattaagat ttaaataaac tgttaggcac
81751 agggctagat caggcattat aaaaccctgt ggttccctag tcaagtcaca
81801 caaatcccca aatattttag cttgtaacag ttttgtcctt cctctcttga
81851 gacaattatt tgggtacttg cttttggcaa taacgtaatt cacaatggaa
81901 gtttcctaac tgtgatggtg ctttaggcaa cttcggagaa tgaagataga
81951 aattatgcat gattatataa catgaagagt ttaatttcta ttacacactc
82001 aatttccatg ccctgatttc tcttaactct ataaacacat gtaaatcttc
82051 tgcagagctt taaagagctc tgaaagggaa aacacctttc catatatgga
82101 attgatagca tagtacaggt caggcgcagt ggcccacacc tgcaatccca
82151 acattgtgag gccagtggga ggaccacctc aggtcaggag cccaagacca
82201 gcctgggcaa catagcgaga ccccatctct accaaaaaaa aaaaaaaaaa
82251 aagagctggg tgtggtggtg cacacctgca atcacagcca atctggaggc
82301 tgaggcagga ggattggtag agtatgggag ttagaagtta cagtgagcta
82351 tgatgtcacc actgcactcc agcttgggtg acagactggt ctctatttaa
82401 aaaaaaaaaa aaaggtatag tgatacacta ttaattccat gtatgctaat
82451 atgagatagc atccatataa actactatca agtctttatg tgccagctac
82501 tgtaataagt cttttcaagt ttaactcact gaattcataa tgaattatga
82551 ggtagctacc attatttccc ccattttaca aatagggaaa ctgaggctgg
82601 gagacattat ttaacttgcc caagtttcta aagccagtta ctggcagaac
82651 tggtatttga acctacttaa tctgattcta gagcctgtgc tatataaact
82701 cttacccact atgctatgct attcattagt atccatttaa caattactac
82751 tattgcaata gctgcaatta tcactcctat agtacagggg aatctatcaa
82801 agaaacactc agctttcact tatctatttc tgaaaacatt ttttattaaa
82851 gtataaggtg catttcactg atctatttt ataattgtca atttatttaa
82901 gtactttgat tatatgatgt aagaaaaatg ttagaaatgt cttctggaat
82951 taaccagaac acaataaatg tgcaaaaatt agaatggaat ttacagagtt
83001 tataggccac tgaagcccat ccatgaaacc cttcatgaaa ctcattcatg
83051 aggccaaagg gcagaacaaa ccctccctga aaatctcaat tgggctttta
83101 gaatttaaat ttaaatgtct atacgaattc tgctgctcag ttttgtcctt
83151 ccactcttct taattttcca gtgatattgc tgataactat tgttttcct
83201 tttactatta atccaaatat taaagatatt tgtaaaaatt taaaacaatc
83251 tcattcttac aaatttttgt tttggaaaat agttttttc ataaagctaa
83301 tgttatttat attaatgtat aacagattat tgttattttt aatgaattaa
83351 taaatatttt aaatttgtt ttaattttca agtacagtaa atatcagtag
83401 atatattcca cataaataaa agcttttggg agtcctcaat aattttaag
83451 agtgttaagg aatcctgaga tcaaaaaatt tgagaaactc tgctttagca
83501 tttgccacta atacacaaat gtctgtctaa agaggatttt tccctcttg
83551 aatcaggatt actggaagca gctaagatgc ctagatgaaa ggtttaccat
83601 cactgctggt taggaaatgg attatgagaa ctcgaacaga gggaaggtga
83651 aatgcaaccg gaggaaacac tctgatatga ggtttgaggc cttcaaaatt
83701 gctttgcagc ataagccaca gtgagtcagg agtaccaggg agtggataga
83751 atgtttattt gtttaactga gacttttag ttcatcaatt attttgaagg
83801 gtagaacact ctgtgggctc tctttctatt tgcttctggg tacaatcaca
83851 aaaaaaaaat ctctcctagc tgaaattaca tgcagtacta gcaaaggggt
83901 ctctttgtta taaactgttc attaattgac gaacatttgt gtacttaact
83951 atgtataagg catctcatcg ttcaatttca aatacaaatt aaaatatttt
```

FIG. 5 CONT'D

```
84001  ttcacatttg ttatcctgtt atgttttctc ttttacaaat tgtctgttcg
84051  tatcttttg  tctctcttta ggccttattc ttgtcaattc atatgtgctc
84101  taatgaattg aaatattttc tgtatattaa acattactaa cctttcctct
84151  gtcacactga ttgaaaaatg atctatttag tttgttgttt tgtctttaat
84201  tttgtaagct ttaaaaagtt aatattgccc ttcagacacc atcccaacat
84251  cacataagaa tttttcatg  ttataaattc tttgtggaca tatttgataa
84301  ctgttttatt atgaggagga ccataattaa ttcaaccatt cccctatttt
84351  ggtcatttag gttttgggt  ttgggttttt tgtttgttta acgtctttgc
84401  ttgctatttt aaagaatgct gcactaaatg tgcatgcatg agatttcttc
84451  tctgtattta gaatattttc ctagaatgga ttctcagaag aattctcagt
84501  ctgtggagag gaacatttt  aatgcatgga agaggtattt attccagata
84551  gaaaactagg caatattagt tgttccctgt aagattttaa aaaacagcca
84601  tggcaccatg gaggactctt cgagtatata gttttagcgc tgggctttgg
84651  gatcacactt cacaacacca gtaactccac aaatgcattc ctagaggctc
84701  tgtgagaggc tgggtaactt tttcttgaaa aggccagata ataaatattt
84751  tagactttgc aggccgtgtg gtgtctgtca cagctactca actctgccac
84801  acgaaagcac ccaaagacta tataagtgaa tgggtgtgtc tgtgtttcaa
84851  taaaggttta tttatggata ctgaaatttg aatttctgac agttcgatgt
84901  gtcacaaaat gttcttttga tttgtccaac tattttaaaa tgtaaaaccc
84951  attcttaacc tgtgagctgt acaaagactg gcagtggact ggatttggcc
85001  tgtgggtggt agtttgccaa ccctcaggct atataatagg tgacttggta
85051  atagacattt attatattga gggttctaga tatactgcaa tgatagggtg
85101  gatttttataa tgaaaaccct aaattcagca tgtatctcat aattaccttt
85151  cgtattttgt atttcagctg gagttaaccg aatttcatac tggcctgctg
85201  atccagaaat aagtttgctt acggaggctt ctagttctga agatgcaaag
85251  ttagatgcca aagcagtgga aagattgaag tcaaacagtc gggcccatgt
85301  gtgtgtctta cttcaacctt tggtgtgtta tatggtgcag tttgtagagg
85351  agacctctta caaatgtgac tttattcaaa aaattacaaa aacattgccg
85401  gatgctaaca ctgactttta ttatgaatgt aaacaagaaa gaataaaaga
85451  atatgaaatg ttattttgg  tttcaaatga agaaatgcat aagcaaatac
85501  tgatgactat aggtttggag aacctgtgtg aaaatccata ctttagcaat
85551  ctaaggcaaa acatgaaaga cctatccta  cttttggcca cagtagcttc
85601  cagtgtgccg aactttaaac acttcggatt ttaccgtagc aatccagaac
85651  agattaatga aattcacaat caaagtttgc cacaggaaat tgcaaggcac
85701  tgcatggttc aggccaggtt attggcatat cgaactggtg agttacatag
85751  atcgtaaatt ggggctgatt ggttgggttg tatttgtctc tgaagtgttc
85801  gtctcattta tggtagagtt cattactca  tagttactta agttttgctg
85851  ttcatacaat atagagaagt tagtgagacc cttgagtaga caactctttc
85901  tcccagcagt tttgggattc cttgtagcct tatattcagt accacatttc
85951  tacatcaggc cctcattaat ctaggccctt ctttctgctt cttgctttta
86001  tgatttcact gttccttgag ccctccacta aaggtaggac aagaagagaa
86051  aggagaggcc cagtgcagtg gttcatgcct gtaattgcaa cactttagaa
86101  ggctgagaca ggaggatcgc ttgagctcag gagttcaaga ccagcgtggg
86151  caacatagca agacctcgac tctaacaaaa aaattagctg gcatggtgg
86201  tgtctggtgg tgcgtgccta tagtcccgc  tacttgggag gctaaagcag
86251  gaagattgct tgagcccagt agtttgggc  tgcagtgagc tacaatagca
86301  ccactgtact ccagctccag agacacagca agactctatc tccaaaaaaa
86351  gaaaaaggag aaaaccaaaa ttattcattt ttgttaactc ttcaatattt
86401  tgatgtactg aatatttaac aattttaaa  aaatctttac aataacatta
86451  attcaaaata actaatagaa tcaaggtaaa ggaatggtga ttattgcaga
86501  ttcttccagt tgctggtatg tcttcaatca gcaagttgag aaacattttt
86551  actgtattgt attaagttgt atatttggaa aaggaaaata ttacttggga
86601  tttttctttg ttatgataaa agatggcatc tgtatttcca aacatggaac
86651  aatattatca catcttacct gatgtaagat ttctcaaagt agaatcatga
86701  tcacttttta aaatgcatct ttgtgataaa ggggaaaaaa catagacagg
86751  aggagcagta gagtaagatt tgtttgggga gtgtactgta gtaggattta
86801  aaaattatcc caagaaagaa gagaaagtca tcagaaaagg tctctacaga
86851  tgctgctggt ctgcagtagt caacagaagg gaggttctca gctggcagca
```

FIG. 5 CONT'D

```
86901 aatagaatcg ccattgaaac ttttataaaa agtacagatg ctatactttt
86951 tacttttata aaaagtacag atgctatact ttttactttt ataaaaagta
87001 cagatgctat acttttact tttataaaaa gtacaaaccc caacccagac
87051 ctattaaacc aagtccctaa caaaatatgg ccaagttcta tgttttaaa
87101 agttccacaa ggtgttctga tgttcgcaga gttaataatt gctcaattct
87151 tcttaaagat tttgattctg taggcacaca ttatatgacc ccaaacaatt
87201 gcattgtgta aaagtctggt ttcatgtaat tatattctat tgtgggttat
87251 atatttgttt ctttgccaac tccagctttg taaagaattt ttctgtaaac
87301 cattcaaaaa gatagaaaac ataaatggga acagctgttg tagctataat
87351 tcactaatta cccttcacta attagaattc agcagaaccc tgcctgtgtt
87401 ccagagtaag agggcgatgt gaatctgcta ttttactgga tcttagtacc
87451 tcttgcttct catagaacac cttatcatac cagctgtgat tccagtgttt
87501 aaagacgcag tatgtataca tttgcattta tattgtttat tagatactct
87551 acactactgt atagttataa gtatatccac tattgtgcag aattttgtac
87601 ataaagccct gcttacgcat ttgatggtca atttaaaaga tttttcaagg
87651 ttaattgttg gtgatttttt ttttacatgg aactcaaatc ctgaataggg
87701 tgcaactcct ctgtcactca ctctactcca ctgtgcactc ttccagggaa
87751 gaaaccatgt cttaatcatt ttttccttag cactaaacac aatgtgcgtt
87801 gaatggataa aacaaatctt tttatccaaa gataaagggt ccacaatccc
87851 ttatgcaaaa cttttggagc caaatgtaaa ggaattcaga attttttccga
87901 ttttattta tttttttga gacagggttt tactctgttg cccaggctga
87951 gtgcagtggc actcatggct cactgcagcc ctcaacctct cagcctcaag
88001 caatcctccc acatcgacct cctgagtagc ttgtactaca ggtgaaccac
88051 caccatgtcc agccaatttt taattttttg tagatatgtc tcactgtgtt
88101 gcccaagctg gtctcgaact ccttggctta agcaatcttc ctgcctcagc
88151 ctcccaaagt gctgggatta caggcatgag ccatcatgcc caatccagat
88201 tttaaaaagg taatatggta catatactgt tatataggac tcccagtggc
88251 atctgggaca gtaccctgta atcacattaa tacatacaga gtgaaaaaag
88301 taggaatatt tgcactaaga ataattgagg gctataaata actcaatttg
88351 ggtcagattt ggccgcaaaa taagtgcatc aaacttcaaa aaaactggat
88401 gtaaaagatt tcagatcagg gactctggac ctgtaattct tccttaatga
88451 taaataataa caatgacagt ttatggaaca cctactatgt gtcaagcact
88501 gagcttggtg atttatatat gtatctcatt taacattgag ggtacttcag
88551 taaggtggat atccctatga tacagtgcgc ttccaattaa gcttttaatt
88601 tcacattatt cagtttggtt tgatgacctc atttctccct aattaataga
88651 tgaagatacc atttcattta aaaatgtaca tatgattaaa atgaattcca
88701 aaacctctaa caacagagtt ctaaaatgaa ttgaaagtag ttgcttataa
88751 ttgcttttg aatgatgaat aaagaggatc catagagatg tcatgaaaag
88801 tatgttacta gccaggtgcg gtggctcccg cctgtaatac cagcactggg
88851 agactgaggc aggaggactg cttgaggcca ggagttccaa aagtatgttt
88901 ctagaatacc cgaaggtagc aaaaaagtgg aaaaaaaaag tgtttagact
88951 cttggggaaa aaagagcagg aggaaggcat caaaaatctt atctatctgc
89001 tttaagtact gagttgtgat ctcttcgtgt cttgctttct catcagatta
89051 ggtgttttcc aaagctaagg attatgcctt cctcctgggc cacagtactg
89101 ataatgagag taggctggag taatcaagaa agttaacttt taaaacagaa
89151 ctcagtggtt ctcagatatg agtatgcctg agaatcaagg gggagctcag
89201 gagtaatgca gattcctaag ccttgcctgc ctctctcaga gaggttgatt
89251 tagggggactt ccatggaagc caggagttgc ctcttttttt ttttttttaa
89301 attttaaaaa caagcatcca gtaattttga tgcaagagga ctgtggagca
89351 ccttggacac tgacatgacc acaggattgg gagctaaaat aaccacacct
89401 gtgttctaga acaaaaagtt cccctctgat tttcagtgat caaagagccc
89451 caggaatttg actcaatgat tgtaagttga cctttccttc aaagttgtac
89501 agagaaaacc ctgtgaatga ccagatcata gggagcaatt tctgtaaaaa
89551 ttatagacat gaaaagattt ttgagaaatt acctcatctg tcaccagcct
89601 tgatgctgag tgacatcaaa tctgttttat atggatgaaa atttattcct
89651 attttaaaag acaagtagta aagaatattc tcttgatgta accaacctta
89701 gctaggcagc agagctgcat gctgatggaa aaatcacatt ttttttttcc
89751 tcctaacaag gtttagtctg tccccaggct gaaacagaaa aagtggcttc
```

FIG. 5 CONT'D

```
89801 tgtgactaag aaacataaca ttaaaaatat gcagtgttga tggtagaaaa
89851 gggggctttt aatatggaga attttttattc tggttttttta tttttttcatt
89901 ttagatttat gcataaatta aataaaactt taaagatttt ggttttgcag
89951 gcaaatataa tcttatgttt ataacttctg ccacttacct tagaaatgag
90001 cataaagcca ttgatttgta ttcttgccca ctcatgttaa actctaaagg
90051 tctaggaagg aacccaattt tgtttacacc aaaatcccctt ttccctctac
90101 tctgtagaag gaagtcatct cgtgcactct gctgttcagc ctcatttatt
90151 tccttcagag cacagcacat aaagtactgt ttgtttcctt gttgctgttc
90201 tccttcacca tccaactgta agtcgtatga ggaagggact acagtttccc
90251 tcaccactgc atcctcagtt ctcacagtac ttggaacata agaggcattc
90301 aataaatgga aattttttgtc aaggatttct ttttctttttt tttttttttt
90351 tttgagatgg agttctgctc tgtccccag gctggagtga agtggtacga
90401 tctcaactca ctgcaacctc cgcctcccag gtttaagcaa ttctcctgcc
90451 tcagcctccc aggtagctgg gattacaggc atgcaccacc acacctggct
90501 aatttttgta ttttttagtag agacggggtt tcaccatgtt ggccaggctg
90551 tgtcaaggaa ttctttatgt cacggtgcaa ggtggaggaa aggccaagca
90601 ggttggatct ggagggctaa gttttagtct atttctttgc ctgtttctgc
90651 atctagaaat ggaaattttta tctgctttac ctttagggta aaaatgagat
90701 catgaataaa catgtttaac ataaattata caaatgcttt gtggtataat
90751 tttgaaaacc agggtttgct tgaatttgag atgggaaatt ttattagagt
90801 atcataactg ttttaaagtt aacctcttaa taagacattc attctagttt
90851 ttaatgcaat tgtggcacaa attttctttg tacctttact ggaaagtagg
90901 tatttaaaaa tgttatcatt ggagggattc acttttagga aattgtaggg
90951 tgaaaccacg gtttcagtta atcctcccca aaatgaaaat gccttagggt
91001 aagttcacag ataattgtta ttttctacgt gtaaatgtgc cacttaacta
91051 ccttagtccc ttattaagat tttgataaat actatggttt tcataattag
91101 tgtaatttgt cttagaaatt tgaaactcaa cattgtatag aaggaaaaag
91151 taaatcctta atatgtagaa tttctatttt gtttttttaat tttctgtttc
91201 agattaatgg ttttaagaag tacagcttta cttttgcaaa ggttttggtt
91251 ctacaggaa attataatct tatgtttgtt tataacttct gctatttgat
91301 ttagaaatgg gcaagatgtc attaacttgc attcttttttc cctcaaggta
91351 aactgaaggt caaagaaagg acaacatttt gtttaaatca gaattctctt
91401 catgtacttt ctagcaatag atagatagat ccataaagat ttgtttatgt
91451 tcgtatgaga agtttgaact ttttcttag caagaacatt ttcataagat
91501 atattttcca tgattagagt ataaataatg ctgggaaaag acaaatttgg
91551 ttgttgtgaa cagttattac acaaaatcca ttagttctga aacctttatt
91601 aaattttatc acctatcaga agtagttgtt tagaaaccgg cttgttaatg
91651 gagaatcaat gaagttgcac ttagttctgg ctacagctttt gagggaccttg
91701 actgtggaca ctgccattta gtggcctcca catacgtatg tgtgactgag
91751 ttggtagtga ctctctctag ttatttggta cctagctccc atattccata
91801 cttaaaagtg tttattttaa tactttttctg taattagtga agatacaagg
91851 attgctgcta catttatgaa gtatgtttca atacaagttt ttattactttt
91901 tggaaaaata tatttctaaa actaacatat cataattttt actgagttaa
91951 atgccatata tctttcagag gatcataaaa caggagttgg ggcagtcatt
92001 tgggcagaag ggaaatctgt aagtatgaaa acaattcttt aaatatttaa
92051 cctggatttt gtttaaacat agttcagtct tcggtgcatt acaggttact
92101 gactgccaag gcgggcagat cacaaggtca ggagattgag accatcctgg
92151 ctaacacaat gaaacccat ctctactaaa aaaaaaaaa atacaaaaat
92201 tagctgggcg tggtggcggg tgcctgtagt cccagctact cgggaggctg
92251 agacaggaga atggtgtgaa cccgggaggc cgagcttgct gtgagcagag
92301 atcgtgccac tgcactccag cctgggtgac agagcgagac tccgtctcaa
92351 aaaaaaaaa atattaatat ttttgtaatg gtgcatttat gaagatctat
92401 aaagatttgc tcatccctca acagtttttct agatagacgc attcattcag
92451 caaacatttg ttaaacactc tctacaggtt aggcactgtg ccacagtgaa
92501 tgctggggat taaagatcac attttatggc ctcatagttt agtgatggag
92551 atgtagaagt aaaatataac tgatatgtaa gtgtaattat aactgatatc
92601 atgagaacat agaggaggaa cctttgcttg gaaaaataag taaatactgt
92651 tggtgaatat tattaatgtt actaatataa tattcttgaa gaataagata
```

FIG. 5 CONT'D

```
92701 atttcttcag acagagcaag tcaataggac caggaggata acatgaatat
92751 tcttggtgaa cattcttttt tttttttttt tgagacagag tccccctctg
92801 tcacccaggc tggagtgcag tggtgcaatc ttggctcact gcaacctctg
92851 cctcctggat tcaagtgatt ctcatgcctc agcctcttga atagctggga
92901 ctataggcat gtaccaccac acctggctca tttttgtatt tttagtagag
92951 atgggatttt gccatgttga ccaggctggt cttgaactcc tggcctcaag
93001 cagtccaccc tcttctgcct cccaaagtgc tgggatcaca ggtgtgagcc
93051 accatgcctg ccctgaatat tcttaatatt aatattaata atgttaaaat
93101 tcttgaagat taggaggata tcatcaggca gagcaagtta atgggaccag
93151 gagaataaca cacagagact ggggtgagag agagaatatg ggaaaacgca
93201 tttgatttgg cacatagagt aagcaacaaa gtggacggga ccatgaagaa
93251 ctctatattc catgtaaaga ttttggactt tatcctggca gtgacatact
93301 atagcacagc actaaccagt agagagaaaa ggcaaggctc aaactgaatt
93351 ttaaattttc taggtgttat atatatatat atatatatat atatatatat
93401 atatagagag agagagagag agagagagag agagagagag agagagagag
93451 agagagagag agagagagag agagtctcac tctgttgcca ggctggagtg
93501 cagtggtgca gtctgagctc actgcaacct ctgcctcctg ggttcaagca
93551 attctcctgt ctcagcctcc ccagtagctg ggactacagg tgtgtgccac
93601 cacacccagc taattttgt gttttagta gagatgggt ttcaccatgt
93651 tgtccagaat ggtctcaatc tcttgacttc gtgatccacc tgccttggcc
93701 tcccaaagtg ctgggattac aggtgtgaac cactgcaacc agctggagcc
93751 atgttttaa aaggaagaca gataaattaa ttttaagaaa atatttaatc
93801 atgtaatcaa taaaaaatta ttgatgaaat attctgcatt taaaaaatat
93851 taaatcttca aaattctatg tgtatttac acctgcagca cctctcaatc
93901 tagactaacc acatgtggct agtggcgact gtatgggaca gtgcattcca
93951 agaatgttct aagtggggaa atgatttgat cagatttgca ttataaatag
94001 aatgaggtag ggctagacag aaaataagga gattaataaa aagagatgag
94051 gacttggaga tgtggggatg ggttaggagg ctagaatcaa gagatattta
94101 gtaactatat agctgactga aaggtgagcc tacattttgc ctcagggact
94151 tcacagaaag taatctgaca atttgctttg atgtttcaca aactcctcaa
94201 gttcactcat ccagtatctt ccctgctaac ctcctccctc atcagtggtc
94251 accatcttgt ctgttactgt acacatacaa tcacctagca caatggattc
94301 caccttcaaa atacctcttg actctactta cctgtacccc aactgttaac
94351 tcctactaga atactaggct cctctgccag aaattcctca gcactctgta
94401 caacttgtct gtgacattca tcacagttaa agttatctgt tcaatttctt
94451 accctcccca gactagaagg ctcatgaggg tagggactct ctgtcttgtt
94501 tacagttgta ttccagcacc tagcataggt ctaactggtg gttggaactc
94551 tcatttgtgt gtacatgaat gctcagcaga cttttggctt aacatctggt
94601 tgttaatgat tttgtggaga atgtcagttt ctagttatct ctagagtagg
94651 ccagcaggca gcacggtgaa atggaaagac acatggctta gagtcaagta
94701 atctgggctt gaattctggc tatgttactt actcattttg tgaccctaga
94751 caattaatca ctcttgtcct cagtttcctt atctgtaaaa cagtaatatt
94801 aatagtatca ctctttaggt tgtttcaaga attgatcaaa tgaaatgatc
94851 catgtaaaac tcagtatggc tgggtgcagt ggctcatgcc tgtaatccag
94901 cactttggga ggcgggggtg ggaggattcc ttgagcccag gagtccaaga
94951 caatcctggg catcatggtg agacccgtt gctacaaaaa aagaaaaaat
95001 tagccaggca tagtgacata cgcctgtggt cccagctact tgggaggctg
95051 agatgggagg atgacttgag cccaggaagt caaacctggg tgacagagtg
95101 agaccctgtc tctaaataaa taaataaata aataactcag catgatgttt
95151 gacatttagt aaatgttcaa acagatttat taatgagata atattttgtt
95201 tgcaggcttt tgttggctca ctattacatg attttatga agctgctaca
95251 gtaatgagtc tgttgatatt atcatgagta attataatat attgaaattt
95301 aatgagtttt atagcatatt ccaaaaaact attacacaca cattactaat
95351 atttcattct aataattgat aaagcattca tattaactac tatttctctt
95401 taaagagaa ataagagcca ttgaagtaag aagttctata ataatatgca
95451 tataatagag gcttaataaa tactgaagat gaaaatgcat ttttatttt
95501 ccaactaaat cacaatagca catttttagc ccaacagaaa ttttctgttt
95551 aaagtattta aagtttttg acttgctaac cagtagcatg gcacagagca
```

```
95601 cataagaaat taacaatcac ttgttgagta cctgctatgt acagaatact
95651 cgaacatgtt gaagggatgg aaaagaaata tataacatgg tttctgctct
95701 ccaggatcta taatttattt gggaagtaat atctgaatca agtgaaataa
95751 tttgttagtt aagtaagata gtatttaatt aattgcaaaa aacaaggact
95801 tccttgagat tatagattag agaggtggtt ggccttcttg gaatttagct
95851 ttgacaagat cacactgcag taggagtatc tggtattata tttttgata
95901 gctcagttta ctgtagaaaa ttgaatgaat attcattata caaagtatga
95951 tagcaagctt caaaaataca ttgcaaagtg tcttttcaga atgttgaaac
96001 taaccattgg tttgctcact ctcgtagaga agttgtgatg gaacaggtgc
96051 catgtacttt gtaggatgtg gttacaatgc ttttcctgtt ggatctgagt
96101 atgctgactt cccacacatg gatgacaagc agaagacag agaaataagg
96151 aaattcagat acatcataca tgcggaacag aatgccttga catttaggta
96201 tgaaatcctt cttggtgtac ttttctttaa aatgtagcaa gggttggttg
96251 aaattaattt tcttataatt gtaatttatt tccttttca aattccaaga
96301 aagtttcctt tcagaagtat aactttggta aagcttggtc ctcactgcca
96351 gacctgaagc tatgacctga cctgaggtca tcgcctcttc aggtcttccc
96401 aatttgttga gcatgtcttt ttttcccttg cctctctcca atatgaaact
96451 gctttaagtt tatcctttgg gatcttgctc agcctctcat atttctggat
96501 gttaaggctc ctttgttttc taaatctgga gcacgcattt attaatacag
96551 ttacacgcca cagaaagaca ttttgagcaa cgatggacta catgcacaac
96601 gtgttcccat aagattataa cagagctgaa aaattcctga gtgaagtagc
96651 cattgtaaca tcacacgtta ccttttttat gttcagatac gcaaatactt
96701 accattgtgt tacaatggcc tgcagtattc agaatagga tttataatga
96751 accaaattgc ttcaaaagag cttttgttag tgattatacc tgttaattta
96801 catcattttc acaaacactt ctcagccttt accattaagg ttaagggatt
96851 aaaaaactgt gtaagacatg actcctgtcc ttggagagct tctaatgcaa
96901 tagggatat gagacggcat ccacctcgtg ctgtggattc tgtgggaggg
96951 gcaaatgtaa agtgctgcgg acattctgga gctgctatgg acaaatggga
97001 gagtgcaagg gaaaggcttt agggaagaac tggcatctga actgagcttt
97051 aaaggattcc tagactgggg caattggaag ggaagggaag accattcttg
97101 cttctagcat aagcaacggt ctagaagtag gaaaatccgt ggtgtgttta
97151 ggagcatgaa tattccagtt aggttggaat gtggacacaa gggaaagaca
97201 gctcacaagg acaggctggg actggactcg agaggacttt gagtttatgc
97251 tccatttggt aggcagcggg gaaatggaat ggcattgaca gagccatacg
97301 ctatagatta tgtaggtagt attgtttgaa cagactagat gcatagaatt
97351 ctgttgccct agtccaggtg aacgtaaata acagtctcaa caaggaagat
97401 ggatgtggaa ggctggcggt ggaggaattg aagatggctg gctgagagct
97451 acgtaagcct cagaacccgg aagtcagtcc ttgcagcccc agttgttagt
97501 cctaaactac cctcagcatg caaaatttca cccaaaattc cctctattct
97551 tttccttgtc ctcttcatta cagatttact tgcttcattt tgtacagagg
97601 tgtgaatata tcaaatagaa acttttcttt taaaattat cctatgatag
97651 ggaagggta agggaactat aagtcaaaac agaacttaag tatttgatta
97701 ttcatttagt aaacatttat tgactatcca ctaggtacca gatagggctg
97751 tgtcatttgt ctaacaagat gagttagtgt ctaatcagac atgattagct
97801 cttaaggtat cagtttcaaa tctaattcca gtattctaaa caggtactta
97851 tttagaaagc attgggggtt ttttctctct ttctttggtg tctgtatctt
97901 cctgatttca tttattttgt aatctgaaac tgaacctctt acttagaatc
97951 aataaattat ttttagttat aataattgtc atgttcaggt tgtatcataa
98001 cacttttgtg ggtttacata ctttgaacat tcagtaattc agcaagtcta
98051 aggcttgatg atcattatta ataatgtcat aaatctgttt ttaaaacagc
98101 tcaattttag tgtttaaaga ttttctaaa aaataactta ccctttcaga
98151 aacgaccttt ctgatatttt ataatttttt ttgtaggtgt caagaaataa
98201 aaccagaaga aagaagcatg atttttgtga caaagtgccc atgtgatgag
98251 tgtgtacctt taattaaagg tgcaggcata aaacaaatct atgcaggaga
98301 tgtagatgtt ggaaaaaaga aggcagacat ctcttacatg aggttcgggg
98351 agcttgaagg tgttagcaaa tttacggtaa gtagatacac atttttttca
98401 ggtgtatttt gtattatgtt gttaggtacc ctgctgcaat attgtaagtt
98451 agtgattccc accctttaa agagtttcaa caaattatta ttattattat
```

```
 98501  tattattatt  attttattat  tattatttga  gacagagtct  ctctctgttg
 98551  cctaggctgg  agtgccagtg  gctcgatctc  ggctcactgc  agactccgcc
 98601  tcctgggttc  aagtgattct  cctgtctcag  cccccccgagt  agctgggatt
 98651  acaggcgccg  gccaccacgc  ctggctaatt  tttgtatttt  tagtagagac
 98701  ggggtttcgc  catgttgtcc  gggctggtct  caaactcctg  agctcaggtg
 98751  atccgcccgc  ctccgtctcc  caaagtgctg  ggattacagg  cgtaagccac
 98801  cgcgcccggc  cgagtttcaa  caaattatta  ttattattga  gtttatttat
 98851  atgtgcaaac  ccttacctaa  ctgcaactgt  tcagctaagg  attcctgcct
 98901  tatgaattta  catctctgta  gagaattgag  ccagtggatc  ttttggtgcc
 98951  atctggtggc  tgataaaaga  aaaatctctg  acccatctct  tccctctcct
 99001  ttctggctta  gagaggtgga  tagaggtgaa  aatacttcag  cagtccccac
 99051  cctttttcggc  accagtgacc  ggttttgtgg  aagacaattt  ttccacagat
 99101  ggggttatgg  ttttgggatg  aaactattcc  acctcagatc  atcaggcaat
 99151  agattctcat  aaggagcacg  cagcctagat  ccctcaggtg  tgcagttcac
 99201  agtagggttc  tgctcctatg  agaatctaat  tccaccgctc  atctgacagg
 99251  aggtggagct  caggcggtaa  tgctcgctcg  cctgcactca  cttgctgccg
 99301  tgcggcccag  ttcctaacag  gccacggacc  agtactggtt  gctgccaaag
 99351  gtttgggatc  ccctgcaata  gtttaaaggt  caccccacc  cccaaacaaa
 99401  gggaggtgca  cacacacaaa  cacacacatt  tctcatgaga  aaaatcagga
 99451  aaacaagaat  atttgtttat  ttatttatat  atttattttg  agatggagtt
 99501  tcactcattg  cccaggctgg  agtgcaatgg  cgtgatctcg  gctcactgca
 99551  aactcagcct  cccgggttcc  agcgattctc  ctgccttgct  accccaccc
 99601  ccctcccccc  acccccccagt  atctgggatt  acaggcgcac  gccaccatgc
 99651  ccagctaatc  ttttgtattt  ttaataatag  agacggggtt  tcaccatgtt
 99701  ggccaggctg  ctcttgaact  cctgacctca  ggtgatacac  cggcctcggc
 99751  cacccaaagt  gctgggatta  taggcatgag  ccaccacgac  tggcccggga
 99801  aaaaaagaat  ttcttatttg  atagttccaa  aaatgtactg  aggtagttca
 99851  tggaaaacac  aagaactttt  aagtctttat  acctcttcac  tatttgggtt
 99901  ctggtttttg  tgggtttttt  ttttttttt  tttgcttttg  tttttgtttt
 99951  gagacagggt  ctcactatct  cacccaggct  ggagtgcagt  ggcgccatct
100001  tgcaatctc  tgtctcctgg  gctcaagcga  tctgcctgcc  tcagcctccc
100051  aaagtgctgg  gacaagcatg  agccactgtt  ctcagcctat  tttggttttc
100101  aaaaagcttt  ttatttggaa  aaaaccttaa  gcatacagaa  aagttataaa
100151  aacactacaa  agaaattttt  tcccagaagt  tgttgacatg  ataccagctc
100201  accctttatt  tcctcaaatg  agaaataacc  acataattac  aaccataaaa
100251  atcaggaaat  taacattgat  acattactgc  cactaatcca  cagattccag
100301  tcaaggttca  ttagctgccc  aagaaatgtc  ttatatagca  ggtttcccca
100351  acccctgggt  accagttaag  aagcttcttc  tgtatttatg  gtcactcccc
100401  attgctcaca  ttactgctta  agctctgcct  ccggccagat  cagcagcggc
100451  attagattct  catgtgagtg  tgaaccctat  tgtgaactgc  ccatgcaagg
100501  gatctaggtt  gtgcactcct  tatgagaatc  taaagcctga  tgatccccca
100551  ttcctcacca  tctggtctgt  ggaaaaactt  ccatgaaacc  ggtacctggt
100601  ccctggtgcc  acaaaggttg  gggactgctt  ttatatagca  aaaggatcct
100651  gtccagaatc  atacattgtt  tctatgacat  ccaatgattt  aatcctggca
100701  ttgaatgagt  taatgtaaca  tttaactact  agaatttgca  gtgggaagaa
100751  aaatgatata  aaagaaccgt  ttatatattt  cagcttttaca  ttcctgccat
100801  atacatcagt  ttgagtccag  gatacctgga  acatacatat  atatgattaa
100851  cttggacata  taacatataa  ttatatatgt  atataatttt  aaatatagaa
100901  acatactatc  cagtgtctgt  catgtgtata  tgaagtatca  taagttttta
100951  ccatttgtaa  tattgtcatt  ttttctaat  tgtcttattt  aaagtttatc
101001  acattttaa  atgagggggt  gttgacatgg  cactgaaaga  aggcagagat
101051  gggaaagata  cctttttgt  aaaactcaat  aaaagcttat  atccaactag
101101  tcagagaaat  ctctacttcc  gtgtttttgt  tttctgtctc  ttcattcctc
101151  ctgaagagtg  tgaataaata  ggttttttcaa  gttctcctca  taaagattaa
101201  gtgacttaat  cataaagatt  aaggactatg  agtgatgggt  tatggagaat
101251  tctgaaatat  cttgcttact  ggtagatttt  aatagctttt  caattgtaaa
101301  gagaatgaag  agatcagaag  aacttaagaa  agggcaagag  aagcagaagg
101351  aggcaggaag  actaagggga  tcttcagggg  cagagatggg  aaaggaagca
```

FIG. 5 CONT'D

```
101401 cccagttggg ccagaccctc ccggaaatac cctcactcag gcacatgttc
101451 caaaggctgt tgttcatggt tgttctctgt tctacctcca gtgaagatga
101501 gctgtccatc ttctcatcct tctcatctgg cctggctgca aatattatgt
101551 agatggttag ctagatacct agttttgtaa atgcaagtaa ttaacatgaa
101601 ctagaatttg ttctaaatct gaatttcagt accaagatta tcaaaaatag
101651 tgtgtgtcaa taaatttggt atttgttttt aagattaaag caaattgaaa
101701 ttactttgaa agatttttg ctttccttt tgataagtta ccatagacct
101751 tgagataagt agttctattc tgtggtgttg tcacaaacca ggctaggact
101801 gggcaacact gtttccaaga atagattta tcaatctata tccatgtcca
101851 catactcagt tctttgtttt ctctttaata tgtgtggatt tttctctatt
101901 aggttatatt acttatttt attatgaaag tagtatatgc tcattgtaga
101951 agactaggaa aataaaaaag aacgtgtatt atctcacaac tcatagatac
102001 cacaattaac atgttgctgt attttctgcc actaaaagtt cttaaaaaa
102051 tattttaaat aatttaacac aatattccaa cccataggcc taacttattt
102101 aaccattccc atgttgttgg cacctggat tgtttctaag tttttacagt
102151 tataagaagc cttttatga atgtccttaa acataaattc aggattactt
102201 gttttacttt tgtctgccca aattaatagg ttttagtggt ttgacgtctt
102251 tcaaaaaatg cctaatttta aacatttttt tggtaatttc tcatgtagct
102301 tcctacccctt tctaagtctt ctctctttct tggtgctagc ctaaaccatc
102351 ccattcgttt aaataaccaa ccatttctag atgtcctccc tttccaggga
102401 cttttaatac atggtaaaat gtttgtcctg tatctcatcc cccctcaagg
102451 ctcgtgatgt taactagtta atctgatgag tgaactgatg cttatggaag
102501 aggctcccgg gtaatccata tttgtgtcct gagatggtgc cctagcaggg
102551 cctttggtt aagtcattag tgattctgat agagattcta tccagctgag
102601 aaaagaaggg ctgtgctata agataccgat tactctccat ttttatttc
102651 tcctgccca atattctatg taatatctgt gaatcttcag gcttccctat
102701 ttattcctga atggttgaga tgaaatacag taatcagagg agatatatga
102751 tatgatataa aatgatatga tgcaggtaat agtttatgat ataacaacat
102801 taaaaggcaa ggtaatcttg gtcatatttt cttttctttt tcttttttt
102851 ttcttttttc ttttttttt ttgtgagaca gagtcttgct ctgtcttcca
102901 ggctggagtg cagtggtgca atctcggctc actgcaagct ccacctcccg
102951 ggttctcgcc attctcctgc ctcagcctct cgagtagctg ggactacagg
103001 caccggccac cacgcccagc taattttttg tatttttagt agagacgggg
103051 tttcaccttg ttagccagga tggtctctat ctgacctcgt gatccaccca
103101 cctcagcctc ccaaagtgct gggattacag gcgtgagcca ctgtgcatgg
103151 cctatcttgg tcatattttc attctttaat acctaggcct tttctagcta
103201 ttataagatt ctctaggacc tggagataga atacaatgcg atgttaattc
103251 catagtactg ggcatgggtt ctaattctat tgcctcctgt agttagggtg
103301 taacctgaga caagtcactc caatcctctg gtcttccact tacttccaat
103351 taaaatgaat gtaaagaatc ttcaacttct ctaagagtat tgattcggat
103401 cccagaagtt atatcattca ggatcactca gtgtggcgtt attagggctt
103451 tgttaatttg aacatgctaa cttcttttc ttctattttt ttaatttttt
103501 ttttttttca agatggaggc ttgctctgtc acccaggctg aagtgcagtg
103551 gcaccatctc agctcactgc aacctccacc tcccaggttc aagcaattct
103601 cttacctcag cctcccaagt agctaggact acaggcgcgt gccaccacgc
103651 ccagctaatt tttgtatttt tattaaagac ggagtttcac catgttggcc
103701 aggttggtct caaactcctt aactcaggta atccacctac cttggcctcc
103751 caaagtgctg ggattacagg tgtgacccac tatgcccagc catttttctt
103801 ccatttttaa gaagttgttt tgatatttaa aatcaatgtg ctggaatgct
103851 atgtattaaa tcctctttaa acaagtaaaa tgtttgtgca ctcttacagt
103901 ggcagctgaa tccatcagga gcttatggtc ttgaacaaaa tgagcctgaa
103951 aggagagaaa gtaagtattt atgtattgag gtgaactttg ttgctgagga
104001 gaaaggatat acagtgaatt ttaatgatca ggtgatgaaa attgtgttaa
104051 tagatggagc atattatttt tgaaggttag attttttgcca ttcaatttgt
104101 tcataaatat ttgtgggtct accatatgct aggtgctatg gaaagtgccg
104151 attaataatt actcctatag aatctacagg ttaatacaaa taattatgca
104201 caaattgact ttataaatta aatgcatatg aaacagtaaa cagcaatgct
104251 cttctataac aaaacaaaag cttattgggg agtgagaaag gaaaaatatg
```

FIG. 5 CONT'D

```
104301 tataattagt acagatggat tgggaccaaa tgatgaggat atatacattc
104351 ttctagagta aacccacatt tgcccagatt ggaaatgttc tggtaacttg
104401 aataatctga ttaactaaga atcatcacag ctaccataat gaattactag
104451 tcttttaaagc tttattattc gtatactact acagatattt tgaatgtaat
104501 ataatctttg agaagtctta caattctttta ggcacataat tttagatatg
104551 agtgctatat aatattattc taaaatagta actataggcc aggtgtggtc
104601 actcacgcct ataatcccag cactttggga ggccaaggca gggggatcac
104651 ttgaaatcag gagttcgaga tcagcttggc caacatggtg aaaacctcgtc
104701 tccactaaaa atacaaaaaa tagccaggta tcatggcaca tgcctgtaat
104751 cccagctact gggagtttg aggcaggaga atcacttgaa tccaggaggt
104801 ggagtttgca gtgagccgag atagcgccac tgcactccag cctgggcgac
104851 agggcaaaac tctgtctcta aaaataaaaa taaaacagta actatattat
104901 cgaattattt ggatttgaag taaatggaag ttttctgtaa gttttcttga
104951 taataacaat tttttaacct tgaaaaatca agaagtataa aggtcttaga
105001 ataattttc tgtgaatata ttgattttca gtgttctgaa ttagctttat
105051 ttgattcaaa tagaaaatgt attgtttgca atttggaaaa aagtacatat
105101 ccactgcatc tttcttttta aaaatttatt agcaaaaaag gctgtatcta
105151 tctatctatc tatctatcta tctatctatc tatctatcgg tctgtctctc
105201 tgtctatcta tacatctgat taaataatgt acactcaatg acagtgtttg
105251 aaggggccaa tgaataattt cctatgttag ggaaaggata caaaaagcac
105301 gaatcataaa aaggttaatt tatctatgct acaatgaaga atatctgttc
105351 attaaaatat attactaggc caggtgcagt ggctcacacc tgtaatccca
105401 gtgctttgga aggctgaggt gggtgaattg cttgagccca ggagtttgaa
105451 accaggctag gcaacatggc aaaaccctct ctctacaaaa aatacaaaaa
105501 ttagccaatt gtggtggcac atgcctgtgg tcccagctac tcaggaggct
105551 gaggtggaag gatctcttaa gcatgaagag gttgaggctg cagtgatcca
105601 tgcttgtacc actctactcc aaccttggca acagagtgag accctgcctt
105651 aaaaaaaaaa aaaaaaaaga tatcactaca agagtgcaaa ggcaagccat
105701 ggaatatgag aagatacttg ccacttataa tcaacaaagg gcttgtatct
105751 aggatttatt attcctagat tactaaggaa aaggaagaca tgctgtggtt
105801 aaagccccaa gattggaagg aggggacaaa aggaaggctt ctggtttgct
105851 ggcaatgttt tatttattga cccagatgat ggttacatat gtttgctttg
105901 tgacagttca actgaacagt taagtttatg tttatgcatt tttgaacaag
105951 tgtttgatct cagtaagcaa taccccattt cctttttaat tatatgatag
106001 ttttactgat atgtaattca tctataacaa atttgcttct ttagtagatt
106051 cacgaagttg tacaggcatc actacaacat aatttcagaa cattttcatt
106101 atctgagaaa gaagtctcat gcctatttgc agtcactccc cattcttcac
106151 tcccctagc cctaggcaac cactctttca gtttttatgg attagtctat
106201 tctggccatt tcatataaat ggaatcatac agtatgtaat tcctttccaa
106251 ttttttgattc agttgagaaa tagacaccag aatcaacaga tgaaagttac
106301 aacaccagct ttgttgttag actggggctt gacttttggg taaatcagtc
106351 tgtctaactc agaggggggac ttgctgctgg atactctctc agtgccagta
106401 gcagggacaa acagagaagg aaggcaggca gtgtgactga caactctcaa
106451 gtgcccttcc actccatgca aatggaaccc aggtaaccca taacaagcat
106501 tcttttttaaa gagtcatgga gctttcaaga aaataagaga aatattctcc
106551 taagaacaaa atagagataa gaaggcattt tgctagaatc tgaggagcaa
106601 tagtaagcga acacaatagc cagagctatc ctggggacaa atgtccatat
106651 aagctgggat ctgagatcag gtctgggtct gctgcaaggt gagtgaactg
106701 aacttagttc acccaatcaa cacatgaaaa gatgattaaa cttattagta
106751 gtcagagaaa tgcaaattaa cattgcacgg aagtagcttt ttttttgctt
106801 tttttttttt ttttttttt ttttatgacg gagtctcact ctgtcgccca
106851 gtctggagtg cagtggcgtg atcctggctc actgcaacct ccacctccca
106901 ggttcaagag attctcctgc cttagcctcc caagtatctg ggattacagg
106951 catgcaccac catgcccagc taattttgta ttttagtag agacgaggtt
107001 tcaccacgtt ggctaggcta gtctcaaact ctggacctca ggtgatctgc
107051 ccgccttggc ctccgaaagt gctgggatta ccggcatgag ccaccacgcc
107101 tggcctgaaa tagcattttt tataagcgta tgccctagag aaactcttgc
107151 atattgtata agagtcagag agacaaagaa tttgttgcta tattgttttt
```

FIG. 5 CONT'D

```
107201  aaaagcaaaa actggaaata acacaaatgt ttgttttggg tggttagata
107251  aaaatattat ggtgtattcc cacaatggac taccatatag cagtgaaaac
107301  aaatgaacta gagctacatt cttcaacatg gatgaatctt agaaatataa
107351  atgttgaatt taacaaagca aactacagaa ttatgatacc atttctgtat
107401  aaagttcaaa aagacatacc atatattggt taaatgtggt aggccaggca
107451  tggtgctcac acctataatc ccagcatatt gggagactga agcgggccaa
107501  ttgcttgagc ccaggagttc aagaccagcc tgggcatcac agcaaaactc
107551  catctctaca aaagatacaa aaattagtt tggcatggtg gcctgtgcct
107601  gtagtcccag ctaccgcaga ggctgacata ggaggatcac ctgagcccag
107651  gaggttgagg atgcagtgag ctgagatcac accactgcac tccagcctgg
107701  gtaacagact gagacagacc ctgtctcaaa aaatatataa ataaataaat
107751  aaaatatact ttaatatata gtatatacag taaagttatt gttaagaagc
107801  aatcgattga taaacacaaa aatcaagata ggagttgcct ctgagtgggg
107851  tgaaagggga tgggacgaga gagggagcgc acgggaattg ataatgttct
107901  agttgttgga ttcggcagta tgttttgttt ttttccatc tccccccaac
107951  acacataatg tagttttatt cagttttaaa caaactgtaa ctcttttggg
108001  gcagtaagtt catgagtgtt cattttattg ttaggcttta gaactcccat
108051  ctgtattatg tatgtattat tatatattac ataatacatt atatatagag
108101  agagagaatg tttcaaatat tacatgatat gatgagaaca agaaagagag
108151  aggggtggct ttccagatct acctctggaa ggcaagtctg agccctggcc
108201  caggtgtcct taggacaagg aaacagcagg gcagaacata caggctcagg
108251  gcaggaaatc cctcaaaaga tgggaagaaa ggggcagaaa gaagcttttg
108301  caggtgatag atatgttcat tgtcttgact gtggggatag tttcatgaat
108351  gtgtacttat gtcagaaatc atgaaactgg actaagcaaa atggctcctt
108401  cctgtgatcc catcattttg ggaggctgag gtgggaggat tgcttgaggc
108451  caagagttca agaccagttt gggtaacaga ctgagaaccc catctctaca
108501  aatattacaa atcaaaaagt aaattaaaaa aattcatcaa gctatacact
108551  ttatgtttag tttattgcat actttaaaca tgtatcattt attgtacaaa
108601  taaagctatt aaacacaaaa gccaggaaga ggttgaagcc atactctttt
108651  cccagcctgc ccagtcagat aagtccgtct tccttccagt ccccagattc
108701  tccctacccc acacacagtc cccttctccc ttaggaggta cattttattt
108751  cttccagtct agtaatagga cgtcccccca ccaaaaacat aaaacaaaaa
108801  gttttatgaa ttacttgccg tacactgttg agtgaattca gttttggtt
108851  tttttttttt ttgagacagg gtctcgctgt gtcacccagg ctggaatgca
108901  gtggcacagt catggctcac tgcagacttg gcctctctgg gctcaaacag
108951  tcctcccacc tcaggctcct gagtagctgg gattacaggt gtgcgccaca
109001  acacctgttt aaaaaaaaaa aattttttt gtagagatgg ggtctcccta
109051  tgctgcccaa gctggtcttg aactcttggg atcaagttat cctcccctcct
109101  cagcctccaa aagtgttaaa attacagacg tgagccattg cacccggcca
109151  atgtgaatcc agtttttaaa agccagattc tgtattgcct gagagtaagt
109201  tatctagatt ggattctcta caattgagaa tttgaagata aaataaagtg
109251  aaagttcctt taacttaagc attgttttgc tcttacaaca tgtaaggctg
109301  aaacaagtgc ccatgggttt gaaatgaagc tgtcctgacc tagcgttatt
109351  ctcaatgcta gatggtgtgt tgagacctgt cccacagaag gaagagcagc
109401  accaggacaa gaagctgcgc ctcggaatcc actaagaagg cctgtctaca
109451  ctgcagggga acctcaagaa cttttcattg cacttctaaa attcagcctt
109501  gttcattcag aaaataagga tggatttgt gaataattga aaagattttt
109551  taaggaagct aatttatttc taggatacaa atggtgttaa taagaatatt
109601  tgtcttttag atttatgtgt gggttttcca taatgtagta gtgtgttatt
109651  ttattacacg aaatgaggga gcaataactt caaccaatgt aatcaccaac
109701  agggactgat ttctatttat cttgactta tattagccaa tttgaaaggg
109751  tctgcttcac aagaggtcat gcctctgcag ggaatcacac acctttgag
109801  aaatattaat tcttttgaat tacaagagtg acagttagta aactgctcca
109851  gggaaataag tgtcatcttt taagagtcag tgtatagcaa accaaaagat
109901  cacatttata cccaaagctt tctagtaatc agaatttact taattagaat
109951  tgactcataa aaataaagtt agtggacttt gtctccattt ttaaagtata
110001  ttttgtaaat gttaattctg tggtcctgtt tatcacagac tttgggtagc
110051  aataggaaga gagtgttatt ctgagacagt gtcgctgctt gatatcactg
```

```
110101 actcttgaaa tcactaacag tgaacctcaa atttggttat gatgttaaca
110151 gagaagaaat atttgagtct ggaatattga aactagcttt cctagaattc
110201 cattaataaa tgctgctccc ccatatagtc ttcccttctg tataattaac
110251 ataggttgtc tcatggcttt gatcttcaaa aggaagagcc ttttaaaaac
110301 atttgccaac ctcaagaata aatactgaaa gtcttgaaag tatggtcatt
110351 tcagctattc cagattgctg tctgtgattt ctcacatttt tatttgctga
110401 gaaacattca gaaaattatt ccaaaaatga aggtacattt tctgttctct
110451 cctaggttag agaggggtgg cctggggtgc ttcatgagaa atgtcttcct
110501 ggatctgcgg tggtcaggtt tgcctctgct tttgttccct gcctttccgc
110551 cacatcacac ggcctcactg ggcttcctac cagtttctca gaattacacg
110601 cacgaccatc caaacattgg ctccatgcca gggctgtgac tgcagcctgt
110651 gtaggaccat ggggagttca gagtcatcat acaaggcagc caagaactgc
110701 cataaacact acacagatgg agggcatggg ataggacagg agaggaggtg
110751 atgtacactt agaggtaact aaggctagtt tgaaaaccgt gaattaagat
110801 attcttatca gtataaaaac actgagattg cttacctccc aaattgcttt
110851 attgtattaa ctctcatgct tcagctcttg gatttgttgt ttctaactaa
110901 catgtcatgt acaccaaaca ttttataaat caatcagtaa atattttgta
110951 agacccaaaa tcctggcata ttgccaggtc tgtggatttg cctgttgggt
111001 gttgggatgg gatatcagag gaagaagcat acaagtggga aaaactgtga
111051 ttagaaaggg aaaaataggc atttccacag tactattaag agaggcatga
111101 taatgccatt ttttttcttc tgtacaactg gtcagatttc aataaataat
111151 cattgatggt ttactgtgta gcctcagaag gtgaagtcta tgagggcagg
111201 gaggtgtgtg tgtgtgtgtg tgtgtacttt ttaactgctg aaccccagtg
111251 tctagaacag tacctggcac acagtaggca ttccataaat atttgtttat
111301 tgattgaatg actgctaaac actgctagac tgcggggatg agatgtgtga
111351 gaaatgcctc ctgatcttaa gacactcaca gtcaagtgga agatacaagc
111401 atggaatcaa gtaattaaga aaaatgattc tcaggccagg tgccgtggct
111451 cacacctgta atcccagcac tttgggaggc tgagtggggt agatcacttg
111501 aggtcaggag ttcaagacca gcctggtcaa catggtaaaa ccccgtctct
111551 actaaaaata caaaaaaaaa aaaaaaaaaa aaaagctaga catggtattg
111601 catgcctgta atcccagcta tttgggagac tgaagcagga gaatcacatg
111651 aacccaggag gcagaggttg cagtgagctg agatcatgcc actgcactcc
111701 agcctggaca acagagcgag acttagtcta aagaaaaga aagaaaaaa
111751 atgtctctgg accagcagac tatttgttag aagtgcatat tcttagggtg
111801 ctccctaggc ttactgaatt agaacctctc agggtgggcc cagcaagctg
111851 gggtttcacg accttgcggg tgattctggt gacctttaag gctgagaact
111901 gccattgtgg atgtaactgt aggaacagtg ggggcacacg aggatttacc
111951 agcactctgg ggagtcatgg aaaggaccct gtagaggcag aggtgatgag
112001 gtggggcctg aggggatcca ggggtttgcc aggtaaacag tgggaatgag
112051 acaaatttct gggaaaaagt gatggagaca gactgctgag ccaccccagg
112101 agcccgcctg ggtttggaga agctctgtgg ggcacttttg acccagatct
112151 ataaattccc agtcttcatc ccttagcctg agaaatcaga acttacactt
112201 aaacaaaaaa tacaatgtct ttctaaattt caaagaatgg gaggatgatg
112251 gtaagttcat aatttgtaaa aaaaaaaaaa aaaaaaaaaa atagctctgc
112301 catttgttta ctgcctaagt ggccacagaa tatgctactg tgaggggagc
112351 taagtgtaag catttgcctg gcttccttca tcccagtcat gcagaacata
112401 cgcaggtgtg tgtattttca ttgtattgct gctgaagctt tttctttcct
112451 ttttcaagac agggtctcac tctgttgccc aggctggagt gcagtggtgc
112501 cttcatagct cactgcagcc ttgactgttt tctgtgctca gcggtcctc
112551 cccacctcag cctcccaagt agctgggact acaggcacgt gccaccacgc
112601 ctggctagtt tatttttat ttattttttg tagagacagg ggtcttgcta
112651 tgttgcccag gctggtcttg aactcctggc ctcaagcaat cctcctgcct
112701 ctgcctccca aagtgctgtg attacaggca tgagccaccg cgcctggcca
112751 agttagcttt atttctgggt caatgaatgg taccaacact ctataaacat
112801 gaactctatc tttagtgaca ctatgataca taaatgagct tatcgcccct
112851 gaatgtctat atctaaaccc acgtaacact tgggaaggag aaagaaagaa
112901 gtgagcccat cttgggacag gagctccttt ggtgagtgta gcacagagtg
112951 atttgttagg gaaagcacat gtcttccag aaggacatga gccagaactt
```

```
113001  tcctggaata cttcccacca ccccatgatt ctcagaaatt ggggtccagg
113051  ccaggatgaa cgagaaagaa accacagttc atcccagtgc tgacacccgt
113101  acccagagag gcccggccg gggatgtatc ccaaggacaa aaggtggagg
113151  gaggaggctg gggggagttc acttcctgtg gagtgaatgg aaacagcctg
113201  gctctgccta atgtgcatga ggggctgggg gtggcttgaa cagcttgaag
113251  taccttgtgt agtgtgtgcg cacattcaca atgttagaaa aaaacaaaaa
113301  caagagctaa gcgagaagtc tgaaatactg tggtgtatga tgctgttgag
113351  ttgcaagaaa tggaagctcg tgagccggga ggcttctgtg tggcagatcg
113401  taactcctga ccaactttgt ttcacccatg atgataacca gcagaggttc
113451  tccaggttgt ttattttttga acatggtaca attcattaac aaatatttgc
113501  cagggcttag cttaccatga gccaggcact gtgaggagtg cagttacagt
113551  ggtgaggaaa accagacaca aaccctgccc tcgtggagct tatcgtctag
113601  ttggggagat ggacatacat cagtattcat gaaaatgaat gaaaggtaca
113651  cagaaaagaa ctggcctccc aacaaataca gggacatgtt ttttcagttc
113701  ttccacttca cagagatctg gtactattat aatggcacca tgggctgcac
113751  ttagtggacc cagaaagttc tactggtttg ggtttttttaa aagatatcct
113801  acacgcttaa gcagggaatc ttttggaaac ctctggaaga acaatcatat
113851  taaacatgca aatagggctg ggcacggtgg cgcacaccag taatcccagc
113901  actttgggag gctgaggcag gtggatcatg aggtcagggg tttgagacca
113951  gcctggccaa catggtaaaa ccctgtctct actaaaaata caaaaaaaaa
114001  aaaaaagaaa gaaagaaact agccaggcat ggtggcgtgg gcctgtaatc
114051  ccagctactc agcaggctga ggcatgagaa tcacttgaat ccaggaggcg
114101  gaggttgcag tgagccaata tcgtgtcact gcacttcagc ctgggcaaaa
114151  gagcaagact atataaaaaa aaaaaaaaaa ttggaccatg acccttaacc
114201  tcaagattct gtgacttgtc agggtggaaa aaaatgtatg taaataagta
114251  tagatgtgat aagctttaat aaagagcagg ggaatttaga gaaactgtac
114301  caagcattaa atgtattatt tttagtaacc agaaattcct tctattgatg
114351  taattaagat tttatagtgt ttgagaggcc aaggcaggag gaccacttga
114401  agccaggagt tcaagaccag cctgggaaac atagcaagac cctgtctctc
114451  caaaaagaaa ctaaaaaatt agccagtgt ggtggtgcac acctgtagtc
114501  ccaagctgct agagaggctg aagcgggaga tcacttgag cctaggagtt
114551  caaggctgca gtgagctatg cttgcaccac tgcactccag cctgggtgac
114601  agagtgagac actgtttcaa atagaaaaaa aactgcatat agtactttac
114651  tctcagatat gagtgttcct gttgaccagg aattttacca ttcctggttc
114701  tctgatgcgg aggtggcctt gtgaaaggac acagtttctg ctgagctgaa
114751  cacgctttag tgtaatctga tgaagaactt ctatgctggt tgcggtattg
114801  gtggaaagtg ttttattttg cagaaaaagc acaaattcca cagagggcaa
114851  cagttatcca ttcactccat agctatctat tgctgcatga cagactaccc
114901  cctaaaactt agtggcccat gccactattt tatttttgcat gattctgtga
114951  gccaggaatt tgggcaagat tcagcagaac agctctactc cctgtggcac
115001  tggctggggt catggacggt tgtgtgccac tggtgggtca gttgagaggg
115051  gggcccagcc ggcacaggga cagtgaggct ggaccatcca aggggcttct
115101  ttcaggtttc tggtgcctca gcttggatgg ctgaaacagc tggcagctgg
115151  ccagggctct ccagcagggt ggccagacct ctatgaggtg gcaagggctc
115201  tgaaagtgaa tgctccacaa ggatgggccc agtgtgtccc ccttgcatca
115251  tgctggctca tggatcactg gccaaggcca gtttcgtggc cacacccaga
115301  gtccatgtgg aggggcctgc acaggacatg aagccaggag gtatagttca
115351  caggggaaca caaaagtaac gttcactgca gggacagagc agatcactga
115401  agggaatgcc actgggaatc gagccccatg tcctggcccc tgagcagagt
115451  tctgtcccca agaccattac tcctcatgga acttttcacc tccctcacac
115501  ttacggcaat gctaacagtc actacacacg gttctgagaa ccttcaaatt
115551  gaagccctca tgatgtttcc taagaagttg cagttgtcca aatccacaaa
115601  cccagatttt agttggcaag tctgagaggt tctgggtaac tgttttgctg
115651  cacaaacgtg ggtattcctg aaagtttaaa gattcatctt caacatgcta
115701  gggaaagcca ccatgatagc tagtctaata atgcccagac catcccctca
115751  ttgatgaatg gaaggctcac attttaagat gaatatgggc cagggaggtt
115801  tcacctttct tggctgaggt tgatgccaaa gtgataaacc ttggtgcttc
115851  ccgcctccct gttccctggg gatgggccag aatcagatgc catcagggac
```

FIG. 5 CONT'D

```
115901 cctgcaggca attctgagaa ttccttttaa gaagacacct gcaggaaggg
115951 tgaaccgctt tctagcccctt ctgcagccag ccactccccc tgccttttga
116001 tgacacaggt tctgcataag gtgagaggga ggacagggtg acatccattt
116051 cttgtaaaaa tgcctcaatg agaaaagggc cacatgcatt tcttgtaaaa
116101 atgcatcagt gagaaaaaca acagcagcag caacaacagc aaatatttac
116151 tgaatctcct agtatgatcc aagcccccaa atcaagaaaa tgtgaatgct
116201 gatgtaaaaa aggaaggtat ttgttcaaac tgcctggcca gtgttttga
116251 agaaaacaga gatctccaga gacccctttt ttggtcctaa gtagcaagca
116301 aacaagttca ttaaatgtgt actgtttatt tgtgatgtct ccaagcagag
116351 tagttggctc ttgttatata tctgggagaa taatcaatga tttatgcttc
116401 tgacagtctt atcatagcca tttacataat ggtcatgtgt atttgtgact
116451 ttaatacccct ctgcatatag ccttaatttt taaatggatt acactgtttt
116501 gctgttgtga ctttgcttgt ttaatcatag ctaagacttt tctgaagtca
116551 aatacttttt ccattatcac agtgaggcgt tggcaaaaaa gtgggggctt
116601 gctggttaca cttgctgaaa ataaatcttg cgtttatttg gactctcaag
116651 attggagctc tgaattcaca tagtccagtg tttatgcaca gagcaccact
116701 ggcattgcca ttgattacga ctggcatgac cactgccaga ggtttagcag
116751 ccctggcaca catccaccaa atgccatttc aatcactcag aaatttctac
116801 aacaacagaa ggcccccac atgttgggat agtgggctgc ccttgcttga
116851 gcacagctga tcgatccaac cactggtcag cggttgcatc tcctcttcaa
116901 cactccccta aagggacaga tcagccgggc tctgctccag catccccagc
116951 gatgaagaag tcaccacctc ctgaagccac attggcctgt cctcattatt
117001 aacatgttat ttttatggag taaactcctc ccccatcacc ccctcagacc
117051 ttgtctataa cacaggcctc tttgtgtctc ctccccctaca ggaatgccct
117101 ggagtacttg aaagtagcca ttgtgttcct gctgtcctgt gacagcctcc
117151 cacctctcct ggaaacttac tgtgtcattg tagctaggtt tgcattttac
117201 agtgaagcat ttttttactt cacctcattaa atgttcacac tgtgaagcag
117251 ggattagcat ttccactgta cggataatga aatggagtct caggttaaac
117301 gacttaccca aggctacact gctaacgatt ggcagagcca gaacatgaat
117351 ctgctccaaa ttcaatgcct ttcataattt tcccaatatg cacttcattt
117401 ttttttcttt tcttttttgag acagaatgtc actcctattg cccaggctgg
117451 agtgcagtgg tgtgatcccg actcactgta gcctcgactt cttgggctca
117501 ggtgatcctc tcaactcagc ctcccgagta gctgggacta taggggcaca
117551 ccaccacacc ttgctaattt ttgtattttt tgtagagatg gagttttgcc
117601 atgttgccca ggttggtctc aaactcctga actcaagcag tgtgcccacc
117651 tcggcctccc agagtgctgg aattacaggc gtgagccacc gcgcccggca
117701 caatatgcaa ttcgttttgt ccagcctctc cctctgatgt cttcattctt
117751 cccattacaa ctccgcatgt ctcctgtggt ggaaggcatc agtggcccca
117801 atttttcacc cttccctttc acatgttttg ccagttccat cagcaggtgg
117851 aacttgttgg gggactttgt tttcaataga ataagatgga aatgtcctcg
117901 tgtgagtttc gacattaggc tcaagaagcc tgtgtgtttc cactttgcgt
117951 ttctgccatc accaaacatc cggagcagag ccacccagc tagcccagcc
118001 gagattaggt gactcccagc caccccacag acttaggaag aaaacattgg
118051 ttttatttaa gttattgcgt ttcaggggc tggttatgct gcagttgcta
118101 agcaatacat ttctccaact ttcaaaaagc ttccctttcc ccacggggtt
118151 cctttcccctt cattacttgg aagcctgtgc tagctttctc aacatcctcc
118201 tcctgtttat tccacaaacc actgctgcct ttctgctccc cctccccatg
118251 ggaaggtgct cccccaactcc tagtggccta acctgcttg ggccctgggc
118301 cttcagtgtg cagcatcaac tcgtcctgaa cctctccttt tttggcttca
118351 taacgcttac ctcttgtcgg cctcgacctg ttcttgtgtt tcttatctct
118401 ctcctctcct cccatggctc ttcctgggcc ctctcacctc tttgcttcct
118451 ctccagggcc cccatccttt cccaggacct cgaggaccac caaagtgctg
118501 acgactgttc ccagcctgcg tctcttccca ggtgcagctg tgtgtgcacg
118551 cccctagacc gctcccccgg gggcctgatt cacagcaatg atcaccagca
118601 cgtgaggaaa gactggcgta ggggagagtg gccagggttc ccgccagaga
118651 ggtgttgcag gagtccaggc gagaagcgat gcggcccaac agggcattag
118701 ggtcaccaga accccctgtc tgggcaccca tgcttctacc tgcagagctg
118751 gagtttgtt tgcagacctt agtgtgggac ttcacattta tccttattaa
```

FIG. 5 CONT'D

```
118801 atctaggcat ggtcagattg cacccaacac tgcagcttgt cctaccgctt
118851 gctaattttg tttcagacac taattaggcg tcgctctcag agaccagggt
118901 cactcaggca tttgatcaat gtgttacttg tgtcccatcc aagtcatcga
118951 taatgttgaa tagaaagggc ccagcaggaa cacagtaaag actgttactt
119001 gttttagcca ctagagggct gcatgtccca gaaattgatg caggtgctgc
119051 ttagaagtga aactaggaaa tgtgagcact gttgggttct atgggtttg
119101 gagtttccag ggcgggggcg cagaggagag tgtagcacac tggggagcag
119151 cagatggttg tagcattcgt gggcaaggag agggaggagt aggggttgg
119201 cagagaccac gaagggcctt aggaacactt ctggggagca atagggagcc
119251 atagaaggac tttaagcaga ggccacacga tcatatttgc ttttttttt
119301 tttttgaga cagggtctct ctctgtcacc caggctgcag agcagtgaca
119351 tgatcacggc ttactgcagc cttcaccttt tggactcaag tgatcctcct
119401 gcctcagatt cctgagtagc tgggattacc ggtgtgcacc aacacacctg
119451 gctaattttt tatttttatt tttgtagaga cagtttccag gctggtttca
119501 aactcccggg ctcaagcgat cctcccacct cagcctccca aaatgctggg
119551 attacaggca ctagtcactg cgcccagccc ctatttgcat cttaaagcag
119601 tcactccagc atccgtgtgg aatggaggga ggaagaaggg aattggatgg
119651 ctgctggttg gttcagaatg agaaatgata aaggtctaag gtgacatctg
119701 aagggaataa aggaggggac agaggaatgt aagtgaactg agcagaatga
119751 gggcagagtg gcaggggaca gaatggcagg agccacccaa caggagggga
119801 gggggaggga atgggaggga agggagggtc acctggaaga tgtgaggggg
119851 ccagggagtg aggagagaaa gaggaaagtg aaattgtgct ttgtaaagaa
119901 tgagtcgtac attcactcac gatagagcat ttattatgtc gcagacactg
119951 ggctagaccc tggggataca ttcatgaggg aaacagacac tgcccctgcc
120001 ctggagtttt gcaccctagt ggagagacag caggtatttg gggcgggagg
120051 ctcctgtgct gggcctggga agcccagaag tgggtattta agctgagaga
120101 gcaaggatga gaagcagcag ccggtgaaga aagctgggaa gactattcc
120151 agcagaagga acggtatcag ggaaggccct ttgggaggga tggaaaagca
120201 gccaggcttg ctggacttgt tgcaggagga aggctcggcc tgatcctgtg
120251 tgctttaagg acagtggtca gggctttggg tttgattctg tgcatcaagg
120301 gaagccacta gagggtttgg gggcaggaga gaaccatgac cagatgcgac
120351 ctatgaaaag atcactttgg atgcttgcag agatggggtg cagtccaggt
120401 gggagccatg cagatgcaga gagctgctca gatgggacac aagtctcaga
120451 agcagaaatg ctgatgaatt ggctgcaggt gagaggcaga gagaactcat
120501 gtgccttcct gggtttctgg catgaacaac tgggggaatt tcaggggcat
120551 cagcagagct ggggaagcca ggtgcaggga gtgacaggaa gtcacatgcc
120601 atatttgaa ctgtaccttg gagagaggga gcctgagagg catccagcca
120651 gcaggtgagt gcatgcatga gcttggagat tgccgaagtc ggcccggagc
120701 cacagaggtg ggagccacgg tggggcacgc acagaccaca gacctgaagc
120751 cttgcaggaa gacagggaga tggagaggag atgcgcagga gactgagtcc
120801 aggcacaacg gtgctcagtg ctcggctctg aggtggagga ggctgagctg
120851 agagagcaca ggagggtgag gttgcctggg cgacaggaga ggagagggcc
120901 tggagaagag gccaccagct ctgtcacctg ctgctgaggg gtcagatgag
120951 cacaggaaat cgctactgga tctggtggct ctgaggccct ggatagccct
121001 gggaagagca tcttccaggg aggtggggaa gccagagatg ggtgggttgt
121051 gaggtacatc acaggtgagg aggtgtagcc cattcgtgga gaaattggag
121101 aagttttgcc ctgaaggagg gcagagagac agaaaagggg ctggaggggc
121151 agctgaggga taaatggtgc ttttttgacg ggtgacgcac atcttgtgca
121201 ggaactacct gaaaacttgt gaagacatta gaaagaagag ccaagaccca
121251 agaagggaat tgaaggtgcg agggaaactg tcatgcccgc cctgccctgg
121301 ccttcttata cgggtgcctg ttcctggct gcaggtcacg tgccacatct
121351 tgattctgat gggcatagca cattgacaac tgaacaaagc cacccggctt
121401 ggaaatggtc cctggtcaag gtgaaggaca cgcctggtgc tgccagaggc
121451 caccaggcag ctgcaggcac gccctcttcc ttcctcccac acgcttggta
121501 gcacagagcc tcattcatcc aggccagcag gtcacagcca tgggaatgtc
121551 atgctcagtt cccagggaaa agggcagagg ctttttcccc tgcagaagaa
121601 ccagtctgca cctagggcct tgccgttttt ccccaagagt cctgtgatta
121651 tataagcatc atctgtccct gatgctgggg tcctggtcaa gacttcccca
```

FIG. 5 CONT'D

```
121701 gggcggggct ggggtgacac agctaggccc tggcctggag ttcaaccacc
121751 ctttgtcctg atggcacttt ataaaaacac tgtcagcctg gtctctggga
121801 taacagggtt acaagcctct ggatgactaa ttggccctca gaactaactg
121851 gatcaaatac aaactttggg atgatattgc gtgccccag gccaggtgga
121901 gacctagact gagcatggac actgccatgg agaaaggaca tgggaaccgt
121951 ggggtccccc tgctgcccag cccaccccac acctcgggtt gaggtgggat
122001 gtaggttaca gataaggtta aaatacaaat ggaggcaggt gaaaagttgg
122051 gtgggtccgg aggtttgaat cgcagcaagg aatggatcgc ttcctcttca
122101 cccagacctc agctgctccc taaatctcag tgaccgccaa atcggtgcct
122151 ctggcccacg tctttcttga gccccagact catttgtcca acggctgcct
122201 ggacatcccc acgccacgtc tccaggcaca ggacactcgt gtgcctctgc
122251 ccccatccc gggctcctg tcttggctga gcacatcccc ttctactcag
122301 gtcacccacg ccacaggccc atgtcctcca gaaatggttc agctatgcct
122351 ggtcaatagt aaatcctaag tatctcccaa gttctatggc tgctgcctct
122401 gggctctggg tttgaatcct gcaccaccat ctgctcactg tataattggg
122451 tgagcaaccc tctcagtccc tgtttccatg cctgtaatat tgggattgtg
122501 aaagatgtca taatcagaat ggagccactt ttgttaaaaa caaatcctga
122551 caaatagagc caagggaagg ccatgaagag aaatattcgc atgcataaat
122601 gcctaataac aaaaactacc acggcagact atgaaaactg caaccttgca
122651 caaaaaatgc ttctaggagg acagctgccc agtaactacc tgtccagcct
122701 tggactggtg tccctcttgc aattaaccct tgcagccaag gatcattact
122751 tcaaagcaac aatacagtcc tcacttttcct tcacctttgc cttccttcat
122801 ctccctgaag gcacacgtgc tttttactct ggcaggcata ctccctggca
122851 gtgccctatt cctgagtaaa catcactttc tttgagagcc actctctggt
122901 tatttaggtt gacaggataa tcacagtacg cacctcataa ggtttctgaa
122951 gactgatgtt aatactctaa agcatctgga gggggactgc cagcagcacc
123001 gagttcgcac tcgctgttac cagctggcgc tcatcatccc accctccctc
123051 attgttcccc ctccaggccc ggctccagag ctctccccca ccagacacac
123101 aggtgttcag gtcacttcct gaataaaggc cagccgcctt aatgatggcg
123151 tcagacccctt agctgggcat ttaaggctcc ctcccggccc tctcacatcc
123201 ccacatgccc cggacaaagc gcacacgcct cgtcattttc cagccatgct
123251 tcgtgcccac ggccctccct gcagcgggaa tctctcgctc tggtgacggg
123301 gctaatgtgg gcgccgaatc tgagcccggc atgtcaccta ctttacctcg
123351 ttggttccca caacaatcct gtgaggcagg tcctcttttg gcctgtttcc
123401 tggaagctcg gtgattctca agagggaaca gctagccgtg gagccaggat
123451 ttcagtccag gtgtggccta tcccaaagtc caggtggttc tagttaatcc
123501 acacaaacct ctcatgagta gatgacattt caaaggaaaa agggacctga
123551 cgtctccgag atgggaaagg atggtagcag ggtgtatgtc agcatctccc
123601 cagggcagaa cacatctggc ggcatctgca atgtctgttt tgctaagcat
123651 gagcgtgttt ccacaattcc ctctctggca ggtgatgaat tagagttggt
123701 cccaagagca catcgtgtca gctgtgaggg gaggtgaact ggggcgggcc
123751 ccgtgtggtc acagctggct ggcgttgtca gagacctctg gctcccttg
123801 ttgtcagggt tccccattcc ctgcacctcc ccccttcagct tcaccactgt
123851 gggcccagtg tgggggggctc tgcactgaag ggtgcctgcc cttctgtagg
123901 tccgccatgt cctcagggtc ggcagaggga tctgcccttc ccccggggct
123951 cctcacctcc tgtctatcct ccccttctctg ctgactcggc cccagtgcca
124001 gctgcagggg acagacttac aaaggcctct gattcccctg ccccacgagc
124051 tccaccacca caggaggcct acagtaaccc cggtgtgtca ctcggggtcc
124101 tgtcccagga tccatcccta accagcaagg agaatgaatt caacagatgt
124151 taaatgaaca aataaatgag tagttgaata catattttg ctttacagct
124201 ttaaatatca gaactaaaac taaaagtgat cttatttttt ccaaccttcc
124251 ctaaaggata aattatcaat gtatattgca acatattctc caaagggacc
124301 ctatgatcac agtattttaa agtaacacag atggctctca gtggagtgat
124351 taaattgcat ctatgttaca ttggttgatg gtaaaggggt tgcggctttt
124401 tgtgtgtttt gatggcgact ttatttagg gtattgtaac tgcacatgct
124451 cctccatgag gaggaagtga tgagggaagg cggggaccct ggcaggtatt
124501 ggatgtgcat ccaccatgaa cttcagcctc tgtagcccca tggtgctggg
124551 gccactggga aatggtggaa tggctggctg agtggcaatc gctcctgtca
```

```
124601  ggaaatctaa gctaatgtta tgtccaactg aaaaagaaag ccaagaaaac
124651  aaaacaggtg cagaattgca atctgaaaaa attttttaac actttaatta
124701  tttaattta ttttctacag atgaagtctc gctacgttgc ctaggcttgt
124751  ctcaaactcc tgggctcaag caatcctgat cccccaactc tgccataccc
124801  gcccccatc cccagcccac ccccatctcc acctcccaaa gtgctgggat
124851  tagaggcata agccactgcc accgctgcaa tctgaaatta atgcctatgt
124901  caagttgaag gactgctcaa aatattggag aggttcaaga ctgaatgtcc
124951  ctacgctata cagaggtcta attagatctt ccaaacatca gacaaccaag
125001  tgaagttaag ttacctaccc ccttgaatga atctagcttt tgaaatcttt
125051  ccgctgagtt atcctttagc gctggtatcc agaattcctt tttccgtggg
125101  ggctgggagg agatgaagtt atctgtcctg ggacagagag ctgaagaata
125151  ggccgagggg cctgaattca cagcctggtt tccaaagaca tggaccttgg
125201  ggtcagccct ggccctaaat cctggctctg tggccagctg tctgatctgg
125251  agggagttac tcaccctctc tgtggtccaa gtttccctcc atcaggtgga
125301  gactcgagtg agatgtctgt gcaggcttag tgcagaccag accgaacact
125351  cagcttttct ctgcttatta tggcagctac ataacagcag tttccatgtt
125401  tcaaaaacaa aatcacacct tgtttacatc catcttcaat cttttcaatc
125451  tttttatgta gactaagtct agcttttcag ggtatcccaa tagtatatgt
125501  ttcagacctt tatctaactg tgagccccca atacaatatc caaaaccttt
125551  ctgaaagaac actcatgaag agatggtgtt cattcatgcc acatgtataa
125601  tattcttttg gataaaatgg caaaacaagt aaaagacata aaatcgtaat
125651  gtcctctaat acaacaggcc agcaagattt gtaaatctgt tttgaaacaa
125701  ctatctttg acattaaaaa cgattccagg aatctttgaa tttcattttc
125751  cttcacattg ttacaatcac tttcagtctt atataatttc tagactgtgc
125801  tatggctcac agcagctgtg tctcatggga aatgcagaca aaccagtctg
125851  gctggtgagg ggggctgtgg aaagctcaca gcccctcctt ggacagccac
125901  attgctcccc cagagccatc aaaggaggtc cgcctatgag gctgagggtc
125951  tgggacattt ccaaggggag ggtgctcctg agtgttttct ccaggagcaa
126001  tcctaacttc tgggcagatg cctggctctg gccaagagcc tcgtccaaga
126051  acattatgat ctcagtccct actggcctaa cgctaggacg cttccagctg
126101  gggaacctcc caggcagcag tgggggagag ttccacatgg tttctgatgc
126151  cctggaccat ccctagttca cagccttgac gatgggacgg gtgcagggtc
126201  actggttggt ggggcataca ggaaggtgtg ctggggccct ggggcagcat
126251  aaggctttcc ctgcctggaa cggtggcaag aacaaacaca gccacacaca
126301  tgcaatggaa tgaaaccaac caagaagtgt gtggtacctt ttatttagtc
126351  agtcttcatt taaatgtgtg cttttgaaat cactaaatat gaccttttca
126401  gaattcaatt ctcacagtat ttacagtgaa ctttgtgcaa acaaatcccc
126451  ctttgtgcaa aggggagct tcctgctccc cctttcacat taataactta
126501  caaattcaga tcacaacaaa accccagact ctagttttct gtttgaaagg
126551  tactgagctg ggataatggg ttgctaggaa agagctaatg caagcccaaa
126601  ggaaataaaa tgttttcttt atcagaaaag aataataaca aggcctcact
126651  ctccaaagga aaacagacgt cccaagatgt tgtggaacag tattaagtaa
126701  ccaaatacaa ttccaatggt tatttcacct tcatttttta tacttacact
126751  catctcttt aattaaataa gcgaaaccag aaaagtgcaa ttcgaaggga
126801  ctctgaactg tcagggaacg ttataaaaat aatctgacgt cagtgactaa
126851  agagtacggg tcatcaggct gccggccggc ctcctgcaag ggcactggcc
126901  agggaggcca cagctgccaa agcggggagg tgcgccaggc cccacatcac
126951  ctgcctcggg gtccatgcca ggcaagaaag aaacacacac ctgggcctag
127001  ccaagggtgg tgccctgcca ggtaactctt caggtacaaa atctacaaag
127051  gggatcagtc ctggagaaca catttctctt ccctctcta ggcagagaaa
127101  tacctggctg aagaaaaact acacaacact caagtaatgt ataagggagg
127151  gttcctgtgg aaggcaacga ttcatgattt agaaactgaa gtgtaaaaaa
127201  tacagatcaa caattgtgcc tttcatt ctt gtaaaatatc gctttaaaat
127251  cccgttttag atggttgatg tctgaaacga aaccacggcc ttttaaaata
127301  tttttgattc caagcctttt tataaggaag aggattaac acctcaatca
127351  tcctagtcac aagagactat tcaggaccaa aactgtatag gcттттctatg
127401  tgttcactaa agactgtgat gggcaattat agaatgacag cttattagaa
127451  aaaatttgct tttatcaaca tctgatacaa tggctctgaa aaaattttat
```

FIG. 5 CONT'D

```
127501 tgatggatct gagaattttt tcacacatga atcatttctc cttccaatgg
127551 ttattgatac tgatagaagt tccccgctga gactccctgg acccatggtt
127601 tgtgcctgct gggcatccca ctatgctgat tcctactcta aaagacactt
127651 acagcagaaa gcattcaccc atgaccatta tgaaggaaat attctgtccc
127701 tcactcaccc tctggaagct aatatggagc agcagtcact ctatccagag
127751 ccacatgttc acagttctct agcaagcagg tcacaccccg tgggtcccct
127801 attccccgtg acccttgttg atccatcctc ttcctgctca gttgctcccc
127851 tgctcacctg gactgcggga ggcatgggtg cgcccactga ggccatgctg
127901 aggagctggg atgaatgca ggacagggag agaggggaga ctgagctgag
127951 agggagcact ggatcctggg aggtgtggat gcactgatta cagtccaaag
128001 acattggcag caacaaagga cacacaatga ctgaaaacat taacgttacc
128051 ttctgggatc tctcagtgcc ctgagcgatc tgtgtgtcta cctacagatg
128101 ggcaaagcat ttttgcaccc tggccccatt cccagttctc ccctgagaac
128151 tcagtcctcc ttgaagactt ggtgatgcct gtcaattgag ctcccattta
128201 gcggctcatt gtgccaggg gctcacatct gcaagttaaa attgctttta
128251 tcaacatctg atacaatggt tctcatttca cataaataat cacagacttg
128301 actaaaatga atatattatt ctaggttaat ttttttccat tcaaatgttt
128351 atactccatc tacccagaac aattacagca gaaaaaatag gcacctccaa
128401 agtcttccca agaatgatga ctttctgaaa tgacacactg tacaaactgg
128451 acaaatgaga cgactgactg tgacaggggc cggggagctc ttcaaggggc
128501 cgttttcttc aagtctcgga tctgtttaat caagtagttc ttctcgtcag
128551 cgaactgctc atcatccgtc ctttcttttt ggaagctgct cagaaactca
128601 atgagtttgg gctgattttt taacaggatc tccacaatag gctgtgtttt
128651 gtgaggactg gccacaaaca cctgaaacaa aaagaaacaa atacttagga
128701 gtgcaagcca gggacctcac ccacgctaca gcagtgcagg ccagggacct
128751 cacccacact actcgcgttt catgcgtgac tgatattatt aatgcgtaga
128801 agcccctgac tctaattctc agtgagggtg atcaatacag tcacacacca
128851 cataacgaca tttcagtcaa caacagacca tgtatacgac tgtaatccca
128901 tagcaccata atggagctga aaaattccca ttgccttgtg atatcgtagg
128951 tcagtgcatt tactcatgtg tctgtggtga tgctggtgta aacaaaccta
129001 ctgcccggcc agctgcataa aattcaagcc cgtacaatta tgcacagtgc
129051 ataatacttg ataatcaacg acgatggtac tggtttacgt atttactata
129101 ctatacgtct aatcattatt ttagagtata tgccttctac ttagtaaaca
129151 aaaagttaac tgtaaaacag cctcaggcag gtccctcagg aggtatccag
129201 aagaaggcac tgttatcgta ggaggtgaca cctccatggg tgttatggcc
129251 cctgcagact ttccagggg acaagatgtg gaggtggaag cagtgatact
129301 gatgatcctg accctgtgta ggccgaggct aatgtgagtg tttatgtctt
129351 agtttttaac aaagaagttt aaaaagtaaa aataaaaaa ctttaagcac
129401 agaaaaagct tatagaataa ggatataaag aaagaaatg tttttgtaca
129451 gctgtataat gtgtttgttt taagctgtgt tattgcaaaa gagtaaaaaa
129501 gttttaaaaa attaaaaaat aaacttttta taaaagtaaa aagttacagt
129551 aagctaaggt tattttatg tatgtattta tttatttttg agacaggtct
129601 cgctctgtca cccaggctga cgtgcagtgg cactatcaga gctcactgca
129651 gactggaact cctgggctca agcgatcctc ccgcctcagc ttccccagtg
129701 gctaggacta caagtgcatg ccactgcacc tggctaattt aaaaagtttt
129751 tcgtagaggc aggcctgact atgactgcca aggctggtct cgaattcctg
129801 gtttcaaaca atccttccac cttggcctcc caaagctgtg ggattacagg
129851 catgagccac catgcctggc cctaaggtta acttattatt aaaacaagaa
129901 aaaaatttt ttaaatcaat ttagtgtagt ctaagcagtg tttatgaagt
129951 ctacagtagt gtacggtaat gtcctaggcc ttcgcattca ctcaccattc
130001 aatccctgac tcccccagag caactgccag tcctgtaagc tccatttatg
130051 gtaagttccc tatacaggtg taccatttt tctcttttat gccatcttgt
130101 tactgtatct tttctatgtt tagataccca aataccattg ggttataatt
130151 gcctgcagta ttcagtatgg taacatgctg cacaggtttg tgctctaggc
130201 gcaatagccc acactatata gcctaggtgt gtggcaggct ccaccaccta
130251 ggtctgcgta aatgcactct gtgatgttcc cacacaaagg acatcgccta
130301 gtgagcatgt ttctcagaac aactccctgc tgttaagcgc cacaggcctg
130351 cacttcacct ttcctatcac tctcctaagt cactagctag gagcacgtgg
```

FIG. 5 CONT'D

```
130401 gagctatcta tgaacatttc atatttgact ttgttttact tttaaatatt
130451 tgttcttaac tataaaatct ttcaaacaga aaataacata acaaatccag
130501 tatacgtacc tcacaaattg aatagatttt accattgtgc ctcaagagtc
130551 tcttttttaaa caaataaaac attacaaatg gaaccaaacc ctcaccttcc
130601 acctttcccc tcccacctcc agcagtgtgc caccatctct gggcacattt
130651 caatccttat cctcctatta catagatatt taaacataaa caacatatag
130701 tatgaaagag cttatgattt ttaaacataa tttatttttt gaacacataa
130751 tatcatcacc tagttcaaaa ttcaaaaagg acaaacgtga atagtcctcc
130801 tctcaccttc cctccctgga ggtcaccaat gtcactgttt gttacatatg
130851 tgaagcttta aaaattacaa ctgctgggcc aggcgcggtg gctcatgcct
130901 gtaatcctag tactttggga ggccgaggtg ggcggatcac gaagtcagga
130951 gatcgagacc atcctggcta acacggtgaa atcccatctc tactaaaaat
131001 acaaaaaatt agccaggcgt ggtggcgggc gcctgtagtc ccagctactc
131051 gggaggctgt ggcaggagaa tggcgtgaac ccaggaggcg aagcttgcag
131101 tgagctgaga tcgcgccact gcactctagc ctgggcaaca gagtgagact
131151 ccgtctcaaa aaaaaaaaaa aaaattacaa ctgcccaggt cctacctccc
131201 agatacgtca actcagcagg tctgtggtgg atgtctagca ttctgtattt
131251 ctatgaagtt ccacagagat tcttatgtga actcctggtg gaaaccacga
131301 tctgatactg actggtgcac tattttgtaa aagcacact ccttagttac
131351 tgctacatac atgaccacat gaccagaatg cagatccaag tgtctctgag
131401 ccctacagag ctctctggtg tgatggtctg gcctcctgcc tctgcctggc
131451 accccctctg cccacccatc cctgtcccat agctgtgcag tgcccaactc
131501 tacagggaac acactatgaa aagggcttagt tatggggcag tggggttttc
131551 atggctaagc ctttaaggtt cctccaccct agcaagtgtg gggaaggaga
131601 aaactaccct aggatgttga gtaccaatgt ggagaataca agactgcaga
131651 ggctcccatc ccaggaggtg gcgatgacat tacatttccg ggtttggaac
131701 aggaaggctc atggtgtggg cggcatgaga gctagtccat gagtcaggca
131751 gagaatgttt acacgtggtg gtaagaaaag cagcattcca ggaatactga
131801 attgtcccac tgcaggctct gaggtgggcg ggacaggacg tgggagcaac
131851 agtaagaatg agtaagggaa cgtgggagct aaggcggcgc cggctctgga
131901 acctgggttc aaattccacc tctcctacat gttagcagtg tgtccaccag
131951 caaagttttg ttatctagaa ataaaaggac ctctgcctgt ctgggtgggg
132001 agaatgtgct ggagaacatc agcagcttca gcacaagtaa gtctcctgaa
132051 agccttctgt tgtcactgta tgtggggagt cgtgcttgct ggaggcaaag
132101 tgcctgaact gaattcaagg cctcgtcact gccccatcac cctaattctg
132151 gtcaactgta cacacgaccg tgggcagcca gttcatagcc ctcccagctg
132201 gttgtcttca ttcatggggc taagtgtttc acactcatcg aacacttaac
132251 cctcacaaca gccctgaagt ataagagctg ttatcctcat ctgttaataa
132301 ggaaacaggc tgagtcatat taataaactt gaccacatag tagtatggtt
132351 aacagcgcag attcagaagc acacagcctg ggcccaaatc ctagcaccat
132401 ctcttattag ctttatgatt tcacaaaact tgtttacctc tctgtacctc
132451 agtttcttca tctgaaaaat ggggatgata acagtacctg agtgccatta
132501 ggtaactgtg aggcttaatg agaacagtat atgtattcta ctccatgcat
132551 tcaaatggta catggcacac agcatgcacc attcaaatgc atggagtaga
132601 acacatacat tgttgcaaaa ttgcttttgc caggctcaca gaactagcaa
132651 gggctgaagc tgagattaat cccaggatgc ttgttctgag aactgatgag
132701 atgtgacatt ttaccaggtg aggttcagaa ctagaaatca aagcccacaa
132751 atctgatact cagttcattt ggccaattta gttctgaaat tgttcataaa
132801 tatgatatat aaattcttca tgtttctgtt ctttccatca aaggtcatgg
132851 actcactcac acagcaagtg ctaaggaata cagaaccctc tctgggaaca
132901 ctgcacgtcc ctgtggtcac gagtggctca tgatgagaca gtctcttggc
132951 agcccacatg gcttacttac agtgagccca ccgctcagcc aggccagggg
133001 acccataaca gagaaggaaa agggtttcct aagcttctgc ttggtgggtc
133051 tacagccatg gggtgacaag gaggaactga cctttgacct tctgggttat
133101 aaagtatcct aggctcctct gaaacaacca atgggaaata gaaatcacaa
133151 agaaaattag aaaacacttt gagacaaatg aaaacaaaaa caaatatat
133201 caaaactcat aagatgcacc aaaagcagtg ctcaggggga aatttatagc
133251 tataaatgcc tacattaaaa aagaaagatc tggactgggt acggtggctc
```

FIG. 5 CONT'D

```
133301  acgtctgtaa  tccagcagcg  tgggaggcca  aggcgggcgg  atcatgaagt
133351  caggagtttg  agaccagcct  gaccaacatg  gtgaaaccct  ctgtctacta
133401  aaaatacaaa  aattagccgg  gcatggtggt  gtgcgcctgt  aatcccagct
133451  attcaggaag  ctgaggcagg  agaatggctt  gaacccagaa  ggcggaggtt
133501  gcagtgagcc  aagatcgtgc  cacggcactc  cagcctgggc  aacagagcaa
133551  gtctccatct  caaaaaaaaa  aaaaagaaa   agaaaagaaa  agaaagatct
133601  cagattagta  acctagtttt  atagcttaag  gaactaggaa  gagaagaaca
133651  aactaaacca  aagcaacata  aggaaggaaa  gaataaaact  tagagcagag
133701  ataaacaaaa  cggagaacag  gaaaatgaca  gaatcaatga  acccaaaagt
133751  tggttctttg  aaaaaaatta  ataaaattga  taaaccttta  gctagattga
133801  ctaagaaaag  aaagaagact  caaatgctaa  acattactaa  tggccttata
133851  gaaataaaag  gggattatga  gagatgctat  gaacaattat  atactaaaaa
133901  attagataac  ctagatgatg  acatggccaa  attcctagaa  acatgcagac
133951  tacccaactg  actcaagaag  aaacagagaa  tctgcagacc  tctgacaaga
134001  gatcaaatca  gtaacttcca  acaaaaaaga  gaccaggacc  agatggcttc
134051  actagtaaat  tctacctaac  atttaaagaa  gaattaacac  aaatctctct
134101  caaattcttc  tgaaaactgt  aagaaatggg  aacacttcct  aacttatgat
134151  atgaggccag  tattacccaa  ataccaaagc  cagagaaaaa  caacacaaaa
134201  aaactacata  ccagtattct  ctatgaataa  aaatgcaaaa  aatcctcaac
134251  aaaatactag  aaaaccaagt  ccatcactat  atcaaaagga  ttctatacca
134301  tgaccaagtg  ggatttattc  cccagaaata  caagggtggt  tcaacataag
134351  caaatcaatc  aatgtaacac  atcacatgta  ctgggttaaa  ctgtgttccc
134401  caaaagata   tgttcaagtc  ctaattctca  gtatctgtga  gcgtgatttt
134451  atttggaaac  acagactttc  tttacagatg  tactcaagat  aagatgaggt
134501  caatactggc  ttagggtggc  tttactccaa  tgactggtga  actctggaca
134551  cagagacgct  tagggatata  gaggagaacg  ccatgtgaag  atggaaacag
134601  agatgcttct  ataagccaag  gagcaccaag  gacctctggc  aaccaccaga
134651  agctgggaga  gaagcaagga  agattctccc  tgagagtctc  caaaagaagt
134701  caatgctgcc  aacaccttga  ttttggactt  ctggcctcca  gaactgtgtt
134751  ttctgttgtt  ttaagccatt  ctgtctgtgg  tactttgtta  tggcagccta
134801  gaaaactaac  acaagtgtac  cgcattagca  gaatatagggg  aaaccacatg
134851  atcttctcaa  ttgatacaga  aaaagagttt  gataaaatcc  aacacctttt
134901  catgataaaa  acactcaaca  cggaggctgg  gtgcagtggc  tcacacctct
134951  aaacccagca  ctttgggagg  ccgaggtggg  cgaatcgctt  gagcccagat
135001  attcaagacc  agcctgggga  acatggcgaa  accccctctc  tacaaaaaat
135051  ataaaaatta  gccaggtgcc  gtagtgcaca  cctgtagtcc  cagctactcg
135101  ggaagctgag  gtgggaggat  caattgagcc  tgggaggttg  aggatgcggt
135151  gagctgtgat  ggtgccacca  cactcccacc  tgggcaacag  agtgagatgc
135201  tgtctcaaaa  aacaaacaaa  caaacaaaaa  acactcaata  taggacattt
135251  ggatattcac  atgcaaaaga  cgaagctgag  cccttatctt  actctaaata
135301  aaaagtaaaa  tcaatcaaag  acctaaatat  aagagctaaa  attttcacag
135351  gaaaatacag  ggtaaatttt  cataatgttg  gatttggcaa  tggtttctta
135401  gatatgacac  caaaaataca  agcaatgaaa  gaaaaaacag  gtaaactgaa
135451  ccaaattgaa  aacttttgta  tatcaaagga  tactatcaag  agagtgaaaa
135501  aaacacacag  aacgggagaa  aatatttgca  aatcatatat  ctgatcagtg
135551  tcttgtatcc  aggatatata  aagaactctt  acaacttaac  aacaacaaca
135601  gaaaacccat  tccaaaaagg  ggaaaagaac  ttaacagac   atttctccaa
135651  aaaagatata  caaatggcca  ataagcacat  ttttaaaatc  ctcaaaatca
135701  ctagtcatta  tggaaatgca  agtcaaaatc  acaatgagat  accacttcgc
135751  acccactagg  atgactgcaa  aaacaaaaca  aaacaaaaaa  acaaaaacaa
135801  aaaactctga  cagtaacaag  tgttgcaaag  atggatggag  ataaattgaa
135851  accctgggcc  aggaatgatg  gctcatgcct  gtaatcccaa  cacttgggga
135901  ggctaaggtg  ggaggatcac  ttgagcccag  gagttcaagt  tcaagaccag
135951  cctgagcaac  acagcaagac  cctgtctcca  caaaaaatta  aatattagt
136001  tgggcattgt  ggtgcacatt  gtagttccag  ctgctcagga  ggctgatgca
136051  gcaggattgc  ttgagcccga  gaagttgagg  ctgcagtgag  ctgtgattcc
136101  agcccgggta  acagagcaag  actgtgtcaa  aaaaggaaa   ggaaaggaaa
136151  ggaaaggaaa  gggaaaggga  aagggaaagg  gaaagggaaa  gggaaaggga
```

FIG. 5 CONT'D

```
136201  aagggaaagg gaaagggaaa gggaaaggga aagggaaagg gaaagggaaa
136251  gggaaaggga aagggaaagg gaaagggaaa gggaaaggga aagggaaagg
136301  gaaagggaaa gggaaaggga aggaaaggaa aggaaaggaa aggaaaggaa
136351  agaaagaaaa gaaattgttg ctggtgggaa tataaaatga cacagcctct
136401  gtggaaaatt ggctgttcct cagtaagttc aacaatgaat taccatatta
136451  ccgagcaact cctttcctaa aaatggaata cattgttcaa acaaaaactt
136501  gtgtagtagt gttcatagca gcactattta caatagccaa aaggtgcaaa
136551  caacccaaat gtcccttaac tgatgaatgg ataaacaaat ttgtggtata
136601  cccatgcaat ggaatattat ttggccattt aaaagaatga agtaccgggc
136651  cgggtgcagt ggcttacacc tgtaatccca gaggccaagg caggtggatc
136701  acttgaggtc aggggttcat gaccagccta gccaacatag tgaaaccttg
136751  tctctactaa aaatacaaaa attggctggg tgtggtggca gatgcctgta
136801  atcccagcta ctcgggaggc tgaggcagaa gaatcccttg aacctgggag
136851  gtaaaggttg cagtgagccg agatcgtgcc actgtactcc agcctggtga
136901  cacagcgaga ccctgtctca aaaaaattaa aacaaaataa aaaaagaatg
136951  acgtgctgat ggatcatgct acaacatgga tgaaccttga aaacagtgta
137001  tgaacaaaac accacacaaa aggccacaca ctgtatgatt ctatttatat
137051  aaaatatctg gaataggcag atccatggag ccagaaagca gactaatgat
137101  cgccagggga tggaggtgag gggcaatggg gaatgactgc ttactgagta
137151  cagggttttcc ttttgggatg atgaaatgtt ctggaactag atattggtga
137201  cagttgtaca acatcgtaaa tacactaact gttactgaat tgtacacttt
137251  aaaatggtta atgctgaatt ttatgttatg tgaatttttac cacaataaac
137301  taaaattgtt acttatatta aaaaaaaaaa aaagggactc caggcctgtt
137351  tatacaaact gcctgatgtt tatgtaatac ctatcagaaa tgtgtggctg
137401  ctctggttac catttgttta caagggagtt gctgtgaagt tttagctaaa
137451  aattgcctgg cattttgtgg tgactacata aataactcat gacagtcttt
137501  ctttcttaaa aaaaaaaaa aaaagattaa ctataataga caaactgatg
137551  ttgcaaacca aaataataga caaactgatg ttgcaaacca aaataaatgt
137601  aaaatgtact ggaatttgca gacaggcatc actggttcaa ttccactgaa
137651  ttcattcact gtaccataaa cctaaggaaa atgctaagtt tgtgcccagg
137701  ttttaaattt ttcttgttt ttattttta tggcttctga actctgccgc
137751  ctctaaaagt agttgctgac tggagtcagc taatgcaata gtgcatgatt
137801  cccttggggc agccaggaca ctggtcaagg cctgagatta acacactgat
137851  gataagaaac acacttctaa ttcaaggtat atggaagcaa gtctttttgaa
137901  tattatgtcc agggtagaaa ttttttttggt tgtctttgtt gtccctgttt
137951  tttaaaaaat gtaattttca aaccaccccc aaacaaatga aactacccag
138001  gacttctcct tttagaatgc cgccttattg cctgtatccc tcagtttaca
138051  taacatgcct gagagatgtg atctgtggag ttctcaggcg tggtgagagg
138101  aaggcaaata tcatgaccac aactcaaata tttttagttt agaagactga
138151  aaatattgca ctctccattt taaaactgaa tgcatttcat ggaaaataaa
138201  atatctacat cttacacaca tatccattaa tttcattcaa attctatttt
138251  gccaacaggg attgagccag acaaggtatg gggaggttag tcttctgcgt
138301  tgctgacctc actgcctttg atgcgtgctg caagcctgga atgctctgta
138351  tatgctcctg ttacggttat gtggaagcta ctccaagcaa aatcccaccc
138401  catcgaagtg tcaaataagg caaccatgtc cttattcata tgactacaca
138451  tctgagtaat aatttagaat attttgacac aatacttgct agtactgatc
138501  agagacaatt aacttttttcc tgtttaagaa aggacttgat tgttaaatct
138551  gcaagctggt tgggtgtcta taagcatcac tgggcccacg acagaattag
138601  actggacccc actgcacatc aagggaggaa gaaaagcccc aggaaggaag
138651  tgagggtggt ggaggccagc agcctgaaag tacaggatgc tctaaaaacc
138701  tctagaatct cctgaaatcc tcctcctcac tgccaccatt cttaccatca
138751  ctctgattac acaagtgata catgtggaaa actagtgaaa taaagaaaag
138801  cacaaagaag aaagtaaaaa aatcactgac ataattcctc cacccagaga
138851  taaccccctgt gaatatctgg tgtatgtatg tgcagcattt ttttcttgtg
138901  cacgtcacta tttgtagaaa tattttaaac aaaactgggc ttgcattctg
138951  tacatagtac tttgtaaact actttttcct taacaatatg tttttttaatg
139001  cttgtagatt cttcttacat tacatgagat gatcgccatt tcaaaaagat
139051  agatatcatc tgctgaatcc ttgctatgca ctgggcattg tgctaaacag
```

FIG. 5 CONT'D

```
139101  tttatacgaa  ttgtattctt  ttatcttgac  aacggctctg  ggaggaagat
139151  acaatttttc  cccaatctcc  aggtgaagct  gagagaagtt  aaagcagcat
139201  ccctgaccac  taggctgtgt  gtgcagcgtg  cgccttccgg  gctgtgctgg
139251  gtgcttccgc  tagtgactac  acgacagtat  ggctgccagc  ttcgccctct
139301  ccatgtgtgg  cagtgaccga  ctatttcgtt  caaatgttct  taactactta
139351  tctaaaggta  ggggcaagga  ggggaaaagg  ggcttggggt  caagctataa
139401  tcacgtttct  catctttaaa  actgttaagt  aaactagtgg  atcaaagaaa
139451  tgggaacgcc  ttctttccaa  agttttttca  gcattttaat  gttgccttta
139501  gacagctaaa  tgcaaggtgg  atgtctggac  acttccttag  agtaacagaa
139551  cacgttgatt  tgaactgaac  aattcaagcc  tgtaggcagt  tttgtaaaag
139601  gaatatagca  tagtgattac  ctatatctca  cggagttttt  aaaaagtttt
139651  tcttaaaaac  agctttatta  aaattcagac  tatatagttg  actcatttaa
139701  agtatacttt  ttaatgtttt  acagtatatt  cacatagttg  tgcaatcatc
139751  accagaatca  attttagaac  attttttatca  tcccaaaaag  aaaccctata
139801  cccattagca  gtcgcccgcc  ccctccgcac  cccaacatgc  tcccagctct
139851  aggcaacact  aatctacttt  ctgccctag  agctttgccg  tattctagac
139901  attcatataa  atggactaat  aaaatacgtg  gtttctatga  ctagcttctt
139951  tcacgtagca  caatgttttt  aaggttaatc  catgttgtag  catgttacga
140001  atgccacatc  ctttttgtgg  ccaaaattgg  attgggtttt  gaaagtattc
140051  aatgagtatg  tccttataaa  gtgtttagca  gagtttctgg  cccgcagcga
140101  ctgctcatta  cagttgctac  ttccttcaac  gtgaaatcac  tgcagtgtca
140151  catacagcag  taatcgcttt  cccaaatatt  tactgttatg  cagatgcaag
140201  ttattaagat  tcatatttaa  acccaatagc  tcattttaac  tattttgggt
140251  aaaatatttt  atcttccatc  caaagaatga  gtatactagt  atttcctcta
140301  gtaatactgt  aaaaagagga  attcatactt  ctaatatact  ttatcacagt
140351  caattgtaga  aagaatagac  tcttgtaact  gggagggacc  tcaggaactt
140401  agctaattca  tccttccact  tcagacacaa  cccactggta  attcttggca
140451  aacaagaatt  gattcctatt  agatcccctg  aaaaggtgat  tctataacca
140501  tcctcaatga  cctattccag  tgtctacaac  tcccgttctc  agaaaattgg
140551  ttttatttat  agtcactctc  cgcagcctat  tgagatagct  gctgttggct
140601  tgcattatga  tattctatga  aacatgtgct  ctgccctcaa  gtaccactgt
140651  taaatttctc  tgtcagtctt  ctttttttggt  gcataagtgt  ttttaaatct
140701  ttccacatag  gtcttgtttt  ccaaatagct  caatcatttc  tgtggcttct
140751  ctctgctgag  cctctctgta  ttctctatac  cctcctccag  gtaagcacct
140801  cagaggaact  gtgcagtctc  cttttcctagg  atccttaagg  agaagtcatt
140851  tacctgatga  catggccaac  ctcaagattc  ccagagctgt  caatataaac
140901  ttcatcccgg  tgaaatctga  ctcgagttga  agagaacact  ggctttgtgc
140951  atcaggggcc  ttcactctgc  tatcacttgc  tcaccctgga  cttttctgct
141001  ctttgtgcca  tcactttctc  aatgatttta  tttccttccc  aggtctgtga
141051  tactgtactt  ttcatcactg  agcttttagc  cacttattcc  tggtttcatc
141101  tacaatggac  aaatactaca  gccattcaga  atccttattc  ttcccggagg
141151  ccttcagctc  catcggaagg  tctggcgaat  gtgatgagca  cacacgctgc
141201  tgacctcatt  ctccaagcct  cagatggaaa  tgtggaccag  gacttcccag
141251  gggaagccgc  ctgcacaaaa  catagattcc  agacctacac  attctcgctt
141301  tctgaatgga  atatgccagg  aaggaaggat  ctaaatatat  tcacaagtca
141351  gaatagttct  atttaacatg  acgatgcttg  tcaaacattt  tgtcagaaag
141401  attttttttaa  aagatactat  attactaccc  aggactctgt  tcttgtccca
141451  atatttgaaa  actgaaatga  gtccctccag  gttagcatta  ccagatttag
141501  taaacagaaa  gagaggatgc  cccattaaat  tctgtttcag  atgaacaatg
141551  agtaattttt  ttaatgttag  tatgttccgt  gcagtgctat  actttggcca
141601  tctcaaattc  aaattgaatg  gggcatcttg  tattttatct  ggcaatcctt
141651  atctggttca  gaggcacaga  ggctctcagt  ttccttcctt  taagaacata
141701  catattggct  gggtgcggtg  gctcatgtct  gtaatcccag  cactttggga
141751  ggccgaggga  ggcagatcac  ttgaggtcag  gagtttgaga  acaggttggc
141801  caacttggtg  aaaccccatc  tctactaaaa  atacaaaaaa  aaaattagcc
141851  aggtgtggtg  gtgggtgcct  gtaatcccag  ctacttggga  ggctgaggca
141901  gaagaatcac  ttgaacctgg  gaggcaaagg  ttgcagtgag  ccgagatcac
141951  accactgcac  tcaagcctgg  gtgacagagc  gagactctgt  ctcaaataaa
```

FIG. 5 CONT'D

```
142001 aaataaataa ataaaaataa aaataattct aaaaaaagaa catacatatt
142051 aatttactta ctcagacatt aattaaatat ttaaatagcc actatgtgcc
142101 aaaaaccctt ctagttgtta ggagatagag cagagaaaga acaaatcaga
142151 ggaaaattcc tgctcgcaaa gcgcttctac gaaatacaaa ggtctggcaa
142201 agaggcactt tgccatttcg aatttaccag cctcagttcc ccacatataa
142251 gtggggctat gtagaagaaa gaacatggga tttggaagca gaagatggcc
142301 ttgtctgtga gagctcaggc ttgtcactta atctctcaga cagttcctc
142351 gccaatgaaa cggacaccac atctgcctga cttcacagat ggggtgagga
142401 tcacatggaa ttttgtcagg gaaagtgttc tgtacgctac aaaatgttaa
142451 aatgttacta acattattgt taatgcaatt gctttggtat tttggaaatc
142501 aaatctttgg gatctacaaa tttcatataa ttgtggaagt tacataggaa
142551 actagacatg tatcccaaaa ttacatggaa aagcaactta aattttttta
142601 tgctaggtaa tattcacaaa cattaagtat aggctgcatt ttctttatat
142651 actactgcaa aaatattttg taaagtaggt aacaacatta taaacattca
142701 gtagcaggat tatcaaacag agccgtaagt aacatattta tatacttgtt
142751 tgatgatgtt gctaaagttt gccagaaata cccattgcaa acctttctat
142801 aaagaaacat agagttgatt gttttatgaa tttttaaaga aagtcttttt
142851 aaaaatagaa aggagaagtg aggccttaat tatgactttc cacattttct
142901 ccttggcttc tttgttaaat atgcaaaagg gtaaaataag atcaaatgag
142951 gacacgataa agctgaatgt tcgacaccat ttaaaagcag ttggtgagac
143001 attaagtcag aagttggtat acttttcaat atgctgttac aattttaggg
143051 gaaattatca ttattaaact agttcatagc caattcctaa attcacttgg
143101 tctcaattgc tttctccatg agtacggtta gatttggtac accatgacca
143151 tagtagtttg gtgtgctaga aagtgggtcc ttaggccggg agtggtggct
143201 cacgcctgta atcccagcac tttgggaggc tgagacgggc ggatcacctg
143251 aggtcgggag tttgagacca gccgggccaa catggcaaaa cctcatctgt
143301 actaaaaata caaaaattag ctgggtgtgg tggcacatgc ctgtaatacc
143351 agctactcgg gaggctgaga caggagaatc acttgaacct gggaggtgga
143401 gggtgcggtg agccgagatc atgccactgc actccagcct gggcaacaag
143451 agtgaaattc catctcaaaa ataaatacat aaataaataa tattaaaaag
143501 tgggtcctta aggaagtgag taattcacgg ttagtccttc actaaattca
143551 tctgtaattt tgcttatttt cagtaagacc acacggaaac tattctcatt
143601 cttgttctac atactttttt ggctgaactg tcaagccgac ttttatattc
143651 tggaataagc tggggacaga acttcttgtt ttgaagggaa tagctattat
143701 agccaaatgc taggatctga gtgacagact agtgccatat ttggcactgg
143751 ccatgcctga gttccagcag ctctgagcga gcaaacgaca cagaccattt
143801 tcttacacct tacatggttt ggtgggaagg ggcaacacgg ccctttgcta
143851 tcaaggttaa cagggaaagg aaagggagaa gatcatctca taatgtatcc
143901 ctcaatccat attgggcaca tctctgggag agtcaggacc agagacaaaa
143951 gtctcctgac ctagtatctt agaattacac ttcagcactt tcattttgca
144001 agtgaaaaaa tgcatccagg tggatttgcc caaagtggct gctggcaact
144051 gagacagaac aaagaccttg ctctcttgac ctccatcggg gctttcccac
144101 cacactatcc tgctcaccaa tagtctaggaag cacgtgctga gcctattagc
144151 aggctaatga gagtcagcca ttaacaatcc agcaaagaca ttttcaggac
144201 tgggttccac attctttgca ccctacggaa ggtgctctgg ggaaaaaaac
144251 ctattaatta aacgatgtga aaacaatcct aggacttagc tgttactttt
144301 ttctaaataa caaaatattt ttggcaagta aacaatgtag ttcatacttc
144351 agtggaagga acatagccgg ggtacgggc aggccaagtt acacacatac
144401 aagtaaacaa gcggtcaact atttttaaat gtacctaccc tgtccaatga
144451 ttaggtgacc caaattctga tcttctcaga ggatggaaat aggttatttt
144501 tatttgcaa cccactgttt ccttctatat ataatactgc attttgaac
144551 aaaattatat gaagtttatt ctcatttaaa gttctgtggg agctgaatga
144601 tatgatacac agccttctac aattccttcg gtccaagggt cttgagaggg
144651 cctatcattt tataatgtgt aggcattttc caggcctaca gcactctatt
144701 tttgtttcat tcttttttttt gaactttttt atgaaataat tctaacacat
144751 ggaagagtac aagagtaaca tatcagactt catattccca ccattggctc
144801 tatcaaaatc taatatcttt tgccatactt gccttcagat tttttttta
144851 ataaaatatt acagatatag ttgaaggcta ttggacactc ctgtatgata
```

FIG. 5 CONT'D

```
144901 tcgcttattc tcttccctac ttcttctcct gagatgacca ttatcctgaa
144951 tttggcattt ggcattccca tgcattttgc aattttgttt gttttttga
145001 gacagagtct cgctcagtca cccaggctgg agtgcagtgg cacaatatcg
145051 gcttactgca acctctgctt cccaggttca agtgacaatc ctgccctagc
145101 ccactgagta tctgggacta caggcatgca ccaccacacc tggctaattt
145151 ttgtgttttt agtagggact gggttttgcc atgttggcca ggctggtctc
145201 aaactcctgg cctcaagtga tccacccacc tccgcctccc agagttctgg
145251 gattacgggc atgagccacc atgcccggat tccatgcatg tttttggact
145301 ctaactgcat atatatgaat ccacacttag tgttcttttg catgttttca
145351 aactttaaat aaatgacata tttaaatatt tggtcattcc actcaacaaa
145401 atgtttctaa gattaggcaa agcgatccac ataactctat ttattttaac
145451 ccattattat gtgctattgt atttgtgtag cacaatttat tttcccagtc
145501 tcccactggt gcccatgtat ggcttttccc attttaaaca atgttgcaat
145551 aaacatcttt gcacagtaag tccttattta aggtggataa cttcttagaa
145601 attgtaactt taagcaaaac aacagataag gcaaacaatt tttccatcaa
145651 atttacaaca aacatggtt attcgaggac ttgctgtaat gtacatggtt
145701 ttgtttaaag tctgcttcca agcacctatc aacgacttta agagaggatt
145751 tactgtacat aacccttat gcacacatcc aagagtgtct ctaagaaact
145801 gcttagaaat ggatttcaga gttgaagggt atccacagct tcaagagttt
145851 attttgctaa actgttctcc aaagtgatta caccaattta cacagtgtat
145901 gacagctccc actgctgtcc aatcctacaa aaatctgata tggttggaca
145951 ttttcgccaa tatgaagaac ataaagtggt atctcattga tattttaatg
146001 gccatttcca caattacaag taagaagaac acctatttat tggccaatca
146051 ggtttcctca tctgtaaact accaacttgt atcttttacc aattttctg
146101 ttatttgtct ttttcttaaa gacttgtcag ttatatatgt cacattctat
146151 cctgtctttt cagtttatga tttctttttt gaacagaagt ttaaaatttt
146201 agtgtggtca cattttaaa tattttctat tatggctggg tatggtggtt
146251 catacccagc cataatagag gccaaggcag gaggatcact tgagcccagg
146301 agtttgagac cagcctaggt aaaacagcga gacctcatca ctgcaaataa
146351 taaaaataga attagttggg catggtaagg gcaggcctac aatcccagct
146401 actcaggagg ctgaggcagg agaactgctt gaggccgaga ggtcagggct
146451 gcagtaagcc atgatcacac tactgcactc cagcctgggc aacatagtga
146501 gaccctgtct caagaaaaat ttctattatg ttttgtgact ttttatttct
146551 ttttaaagga attcttccta ccccaatatt atatagacag cctcttattt
146601 tctcttctaa aagttaaaaa aaattgcttt tctagtgcag atctttatct
146651 agaacttatt tctgtgtata ctgcagggta agattctcta cacagacaac
146701 ccattatcca agaaacattt attgaatatt taacccttc ttcactggtt
146751 tataatccct ccatgatcaa atatcaagtt tcggatttat ataggtttat
146801 ttctgggccc tctactctgt tttgctgttc tatttatcag cttctaaggc
146851 aatacaatgc tgttttcatt tactctaaat ccataacaag tcttaatatc
146901 tggtagagaa gattacttcc ttcttcaaaa ttgccataga taatcctagg
146951 ctattgctct accacacaaa ttttagaatc agcttgtcaa gttccaggga
147001 aagtccagtt gggattttga atggaactga ataaaattta taaattagtt
147051 gaggatttta actgctctaa tgggcttctg gacaataaat atctgggctg
147101 gagcttccag agagccgaac acatggagac tcctgagggg tggctgctca
147151 gggaaggcat ggaagctcca tgcccctttc cccataccct gtcctacata
147201 tctcttcaat taaaaaaaaa aaaaaaaat atatatatat atatatat
147251 atatatatat atatatatat atatatatat aatgatgtaa taaatatctg
147301 gtggctgaaa gatcaactaa aaatgtctta cttttcaaag caacaattac
147351 cttataaact gccatgcctc ccatttatgg acttacaaat tctatcacta
147401 aacattcttt ataaaactg agatcaggtg ccatggttca acctataat
147451 cctgtaacta ggcagcttaa cttcaaagtg catttaaaac atttttcccc
147501 tttctcttgg gttaaaaat gtaaccttga agcaaactgc agaagtgttt
147551 tcccttagtc ttaaaataga ctccacgacc cacccctttc tcactgtcta
147601 tactcccttc acatttatct aactgcatgc tggtatctaa ttatctgcct
147651 acttagaagt tccaggggct aaacgtgaat cttgagtcag acagaccaag
147701 cttggagacc cagctgcaaa attccagaga taacctcaag gtggctagtc
147751 aacaacccag ccatcgttga gacgatgcca gcctgctttc cacctggact
```

```
147801 gggacccaag acagctacca gaacaagaaa tacagacact gtactcagca
147851 taattttttac atgccttcca tatcatgttt tctctttta aaaccttgcc
147901 ttgcccctaa aattcaaagt agttgcgttg gatgggaatc tggccacttt
147951 cctattatta cttttggcta ataaagtaac tttctttta ccagacctgc
148001 ctcttgttaa ctggactctg cgtgtggtga gcaatccaac ttgtgttcat
148051 ttacaatccc agcacttaga ggctgaggca ggaagatcac ttgagcctaa
148101 gattttgaga ccagcctggg caacacagca agaccctgtt tcttcaaaaa
148151 ataaaaaact tagctgggcg aggtggcacg tgtctatagt cccagctact
148201 tagaaggctg aggtgggaga attgcttgag cctaggaatt tgaggctgca
148251 gtaagccatg atcacaccac tgcactctag cctgggcaac agagcgagac
148301 cctctctctg aatttaaaaa ataaataaaa tttattttt atttagaaaa
148351 atatttattt ttttatttat tataaattta ttatttattt tttatttatt
148401 agaaaaaaga accaaaaaaa tctggaactc tctgaatgct tatttccact
148451 ctaggtatct atcagaagat aagaatctta aatattaaaa aaattagctg
148501 gatgcataaa atgcacattg tagcattact tagagtagga aaaaatgaaa
148551 gtaacctaaa tatcaatgac ataggactat taaactagaa gaaatatacc
148601 caatgataca ctatgatggt gagaaatata ctggctctaa aaactattta
148651 tagcaataat gaaaatggtt acttatggta tagcattaag taataaaatt
148701 aggatatcag ttgttggtac actgtgaata cagctgtaga aaaaactctg
148751 gaatgtgtgc actgaaaaat aaaatgtact aaactattta caatagttag
148801 gctgggaata cagaattaca aatagaattc tcccacctac tccacctgtt
148851 aaaaaaatct attgtagggc caggcacagt ggctcatgcc tgtaatccca
148901 gctctttggg aggccgagga gggcggatca cgaggtcagg agatcaagac
148951 caccctggct aacacggtga aaatcgcttt tactaaaaat aaaaaaaaaa
149001 ttagccagga gtggtggcac acacctgcag tcccagctac tcaggaggtt
149051 gagggaggag aatcgcttta acctgggagg cagaggttgc agtgagccga
149101 gatcgcacca ctgcactcca gcctgggcaa cagagtgaga ctccatctca
149151 aaacaaaaaa caaaaaacaa aaaaccact attgtctaaa ggggttactt
149201 ttctatcata acaaaataca ttgtaaaaaa ataataatat taataatgtg
149251 agtagtaccc gactgtgtct tcagggcgtc atttaaagtt cgaagagaca
149301 gtgcttgtag gaagcaaagc attcaaggcc gacactcagg gtttgggatc
149351 tagctcaatc actgattgtt ttagaagttt tgggaaagag tatcatgcat
149401 tttctccgtg aaaaaataaa aatatttaga tgtatggatt agtcagcaaa
149451 cctttatgaa tgggcattca ttaagataac tctgaaattt catctaaatc
149501 atgcaaaaca caaagactgc ctatttcatt ttctttcaag tatgaaggag
149551 agtaaagagc agggagtttg ccatttggaa ctggaaaaaa aattgcctac
149601 aacattgttt ccagagcttg tacttttac cttaaaaaca tgaaaggctt
149651 caaactggat gttgggactt ttatcccgaa ggaggttcat catgagtttc
149701 aggttctccg gcttgctgat atactttgtc atgatggcaa agttgtgacg
149751 gtccaggatc agctccccta gcagctagag gaaaacacaa aaccaaagct
149801 gtaatctcag agccacctga ttcaaaatat agctcacgtc ttctcactga
149851 aaaacaaaat ataaatgtga gtaagaatgg tgttgtgaaa aaaattagag
149901 tgtccttaag tgcatctcaa agcacaggca taaaagcaat agttattgag
149951 caatttttc acactgcttt gctgatgtca gtgcttagta cctttttta
150001 gttggtcttt gctgcagctc acctagagct aggcagaaat aaatttatgg
150051 ttttcaatac tcactttaat tatcttgctt cgcactaatg tattgctcca
150101 taggcattca ggtagaagta ataacaaaat tggtaccata atgatacctt
150151 ctttacctgc ataaatgtat gctaggagtt cactattaag acagtttgtt
150201 aaatgactct tacatttccc ctgacttta ttataaaacc tgatataaag
150251 tcagaaaaaa aattgacccc aaatctgtat caaatttagt aagtgcagca
150301 agtttgtatt aaaagcaaa gcaaacatt ttttggtgac aaattgatag
150351 ttccccaaat acagcattac cctaaaacaa aataaaaata cccaaagtaa
150401 gaatagttga agaccctcta gcaacatggc tgaatgtatt gttgctctat
150451 cttagaaact ttttgttctc accataattc tggagaacag aattatagcc
150501 ccctggctgc tgtagcaatt cctaaagctt cagcagccag ggggctgaaa
150551 catactgtaa tataacttta tatagaagat atgtttagtt ttcaattgtc
150601 ctatttactg gacttttct gaaggcctca ggggagtaac acatcattac
150651 atggttacag aaatcctgga tgggaagaaa agcgcacatc aaactgaggg
```

FIG. 5 CONT'D

```
150701 ccaactgtct atcaaaggag tcccagatgt gtgcaagcat ctggctgcca
150751 gtaaaccacc accttgcctg tgatgtatct tttgtgtatt taacatgaaa
150801 gaagtataca acctgaggtt atttttaatgc atgaaaataa cgtttgtcaa
150851 acctgaaaaa aggatgaccc ctgttggatg ttggctggtc actagttatt
150901 ctcatacaca tggaatagca accacgtagt caaactgtta atctgcaacc
150951 tccttcatct ttctgcagct ctaacgtta acctaacacc ttctggaaac
151001 tttctttgct cctggtttcc taccttgtgc agcttgttcc cttgctacct
151051 cttcaatggc tcccttgcct tttgcactac ttatgcagca attttccaag
151101 ctgtatactt ggatctgcta tcttttatct cccaacagtc tcatctatac
151151 ccatgggttc aactgtaaca tctaggaaga tgtctcccaa atctacattt
151201 ctagtctccg cttctttcct aaactctaga cccacatttc tttctttctt
151251 tctttttttt tttttttttt tttgagacag agtgtcactc tgtcgcccag
151301 gctggagtgc agtggcgcga tctcggctca ctgcaagctc cacctcccag
151351 gttcatgcca ttctcccgcc tcagcctccc gagtagctga gactacagcc
151401 acctgccacc atgcccggct aatttttag tatttttagt agagacgggg
151451 tttcaccatg ttagccagga tggtctcgat ctcctgacct ggtgatccat
151501 ccgcctcggc ctctcaaaat gctgggatta caggtgtgag ccaccacacc
151551 cggcctctag acccacattt ctaactgccc actgggcagt cgcacttgaa
151601 cactgctgga ctgtcacact tagcgtctct aaaaccaact cccttcttc
151651 tctttgttaa tggcaccagg agctgccctc ctccggttgg gaagagaatt
151701 ggtcttcctt agctcctttc tttcccttgc tcctcacatc aaatctccat
151751 ctaagaccta ccaatttttct gttttaagt gtttcttgaa caccctttcat
151801 tcaatgttca cagccagtaa tctcattcaa accctcacta cctttcagct
151851 gacctactac cacagcatgc aaaatggtct ctccttcagt cctcacctaa
151901 tccgatccat tctgcacatt ttgtcaaaga aatcttccaa aaatcagtat
151951 ttgttaccaa ttccacttag attagaaagt gaacgaataa acaagcaaat
152001 tcctagattc ccatagattt agaaaaaagt aactcattaa gatgccgttc
152051 ccagcctctg tgatgtggaa tcatttctcc tgcttccttt cctcagctcc
152101 cttcctccat cttccccact ctcctgtctc tgtggcttta cttccccagc
152151 tccaaaatct tgagaaacac tttcacctct tctctgcctg ttcaaacctg
152201 gcccatcctc tcagaaccag ctcagacatc gtcttcggga aagcctttcc
152251 tcttctctac agttgacttt gctttgcctt gtagtgcaga gttatttgtg
152301 accctgttta aagaataagc tccataaggg cgtgtttcaa atccccttac
152351 aacctaactg tgtgatgtgc atgggtattg ttggggaaat aaaagtccta
152401 cccacatatc cagagcacaa tacagtaact catctctgaa aaagagattg
152451 caaacagaca aaactatccc ttattacagt caagaagcta caatccatta
152501 catatatata tcctcaagat gaagggtaac ctgtccactg ggggaggacc
152551 tgactaccat ttctgtgcac tcttttcatgg ttcccctaa tgcacctagc
152601 aattaaggtg accatttgtt ttagctattt atctgaataa taaaacttct
152651 cttatctctc tgacaagcaa atagttggaa aagggcacct aggttaaact
152701 ctccttgtga cagagagata gtattatctt cctagatgct tatatttcaa
152751 aggtagggct tccagaccct ccaaaaagaa aaaacaaaaa ctaaaaaact
152801 tctgggttgt aagcctgtcc agagccttac ttatcttcta aagatatata
152851 caaaaataat caaatactga atagacacat atatatcata tacactcatg
152901 ttaaaaggct tcagcaaaag gaaaatttca ttttttgaaaa tttacacaca
152951 cacactcaat aaacatttgt tgaagttata tttatgagtt aagttcagat
153001 taggtcacttt caatttttat tacctgggga tacctacata taaattctat
153051 ccaatctatc ctctgctaat agaatttcac aattttttctg aaacaattaa
153101 ttgtgttaat tcaacactaa atcttttagc cattaaatgt taatctattt
153151 taatattaac aatgacaaaa tgctgcattc cagaataata caaagcacta
153201 taaagcaata ctataccaag taaatgggaa acacacatat tttacttctt
153251 taaatttctt attttgtatg cctcatagta catagttaag ccatgcagca
153301 agtggaaata agttttttag aaacctaagt gttttaatga aattgaccag
153351 agcccaaaaa attccccagt ttccaccaag cttcttttga attataatct
153401 ttcttgctgg taattaaatg ccaggcctct gcagaagata aggaaaaaat
153451 tccaaagctc tgtcacatga tggaaggaa tttctctgtt aattattttt
153501 tattgacacc aggaattaag cagtgcagga aaatttagaa tatgattaat
153551 aaaaggcagc aggtagcaac tactttggaa tcagaaaata gcctagtact
```

FIG. 5 CONT'D

```
153601 taagacagtt tattacttac aaagttgcta tataataatc taacctctct
153651 tgtttcctgc aattatgaaa catctatgta aaaagtatta cagaatccat
153701 ttatacagaa acacagttgt gtcaaaatag aatatactgc taccacagat
153751 ctaattacca aaaggaaaaa ccaaaattgc atcagtggag cttccagaat
153801 gtttttctag caaaaaaaaa aaaaaagagt aaacaatatt taatgagctc
153851 tatgttttata tatgagctta tttcacagtc gtctaccttt ttgtttgctt
153901 gaacagagtg atgcaaaacc attttggcaa catctcttcc tataatctaa
153951 cattaaaaaa aaccaactct ccagtaacca ttttaatact ttctgcattc
154001 ttaggtaatt tatctgcatt ttgtcaggca tttttttcca gtgtcctatc
154051 aattcttggt tttaccatgc tataaatcag atatccatga gatgcctaac
154101 tgtaaagatt ttaggaggaa tagcagccaa atggtatgtc tgggtgaatt
154151 aatgaaaaac aggaaagatg cctcgtgaat aggctaaggc atctgcaaat
154201 aagtaggaaa tacaaacagc tttcttcctc caaatttggt tcaatcacct
154251 tagttcacat aaatctctcg attttgatcc agtatctgat agactcccat
154301 tgaaaaaaag gaaggatttg gagaatttat gagcaacttc ctatatgctg
154351 gaccttcaga gcactgtcac ctctgtttac tactccaatt gccatcttcc
154401 ttccagggcc actactcgtt gtaccatgga caagcttacc tcatttggct
154451 atccttgtgg agccctacaa ataacgagtt ctgttcttta cgtatgcagc
154501 tgtataaaga gaatacaacc ttatcttcat ctgctcttag caagctttct
154551 ggacatggga gaacacagcg ctgaagtcac tctctgccca aaggtcagtt
154601 ccacacacag tttggtctca tcactactgg gctttttttc tagatgggtc
154651 tcctggtata agtttctaca caaggggaa actcaataaa aagtgctgga
154701 tggctggctg aaaaatggcc tccccattaa cacccagtga gggtacaaat
154751 ataaaggaaa ccaggtcatg gctgatgcag gatcgtgggc aaagtaaatt
154801 gacaaaaaat gtgatacaaa acagattgac tttattgtct tagtttaaaa
154851 ttatactcca aatttagaag caaatgcatt gttctatgaa tgccatcatc
154901 ttgacatgta aaaataacac aagtgtgtga cactatatcc caaacctaga
154951 aaaaatagga aaaaatgaca atacaagtgt gatgtttagc aagctggacc
155001 atcatatgag ttgctgcact aaaaacagtc agttttatca tctgctgaaa
155051 acattctttt tgtgggattc tgagagggat ctgaaggaca gagacacaac
155101 tccagcccac atctccctcc cctcaggggc tctcccacct ccccctggcc
155151 acatggctgc ttccaggcac cattccactg tgggagagag ggccacttat
155201 agatggatgt ggtcttactc tgttgggttc cctgtcattt ccacagccag
155251 ttaataggtg cataacctca agtagcagat gtaacttggt ttcacacaac
155301 acacacatac acacaaaaac acccttatca gagccatctt aattttccat
155351 aaatttagcc ctctgtttaa agatcaactc atcaaggact tcactgatcg
155401 tctagctgct ctggcgcaca cacacacaca cacacacaca cacacacaca
155451 cacacgccta tctcccaagt cgccgctttc tgtctccttt ccctactctt
155501 cttttttagta cttaaaacca tctgaaaact atgtatttat ttgtttattt
155551 gtctattgtc tgttttccaa caacagaatg tgaggcccag agctgttctt
155601 ggctgtcatc atatgtctgg agaatgagca cataaatatt tgttaactaa
155651 atggaatgtc ttattacctc cctcacacct ccttctccaa taattcatca
155701 aactatgcta tttacgggta attgagaatt ggctttattt tcatttccag
155751 ctagctgcat cgtcttttaa tctcttgcca gattctgttt cagtgtaatc
155801 ctggcagtat tttagaaaag caaaatttcg gtatataccc aaaggactat
155851 aaatcatgct gctataaaga cacatgcaca cgtatgttta ctgcggcatt
155901 attcacaata gcaaagactt ggaaccaacc caaatgtcca acaatgatag
155951 actggattaa gaaaatgtgg cacatataca ccatggaata ctatgcagcc
156001 ataaaaaatg gtgagttcat gtcctttgta gggacatgga tgaaattgga
156051 aatcatcatt ctcagtaaac tatcgcaaga acaaaaaacc aaacaccgca
156101 tattctcact cataggtggg aattgaacaa tgagatcaca tggacacagg
156151 aaggggaaca tcacactctg gggactgttg tggggtgggg ggaggggta
156201 gggatagcat tgggagatat acctaatgct agatgacgag ttagtgggtg
156251 cagtgcaaca gcatggcacg tgtatacata tgtaactaac ctgcacaatg
156301 tgcacatgta ccctaaaact taaagtataa taataaaaga aaaaaaaact
156351 gtaaaaaaga aaagcaaaat ttcgtatatg cgatcatgta gtcttctgac
156401 atatctgttt gttagaggtg attttttaaaa aacatttctc ttctaattct
156451 tagggaatga ccatgtttca tatttcagaa tctctcccgt aaatatcatg
```

FIG. 5 CONT'D

```
156501 tgaacatgtc atgttaagtg gtggaagtat tttaagcaac ctgcaggaaa
156551 acactgactg tcgtgaatgc tcagggaatg ggacctggtg atgaaatata
156601 gcataaaaaa ttctttagga aaatatgtta caaatctggg agataaatgc
156651 ttcccataaa acagaagccc cataacattt caactatata aacataattt
156701 gatagtaaaa agctatttta tactcaaaaa tacagatatt aagaatttat
156751 caattgctgt gcttaaaact tagagggaag gtttaatttt tgcattttac
156801 atgtctttt tttttttttt tttttttttg agatggagtt ccgctcttgt
156851 tgcccaggct ggagtacatt ggcacgatct tggctcactg caacctccac
156901 ctcccaggtt caagcgattc tcctgcctca gcctcccgag tagctgagat
156951 tacaggagcc caccaccacg cccagctaat ttttgtattt ttagtagaga
157001 tggggttttg ccatgttggc caggctggtc tcgaactcct gacctcaggt
157051 gatccgccca cttcggcctc ccaaagtgct gggattacag gcgtaagcca
157101 agatgcctgg cctcagcaga atattctaa attttactta tcatgtactt
157151 atattgttac ttccaaaagc aggacaggac acttacatta ttttgctata
157201 aaatacagtc ataacataaa atatagtaaa tacttctcaa gttatttaaa
157251 aaaaggatat tttaattttt ctgtgtttac tcatatacta atagaccgt
157301 catttgctaa tgagatataa acttacgggg acactgactt aaagaaattt
157351 gatattacct ttaaagactg tctcttagta acataattct cagactgaag
157401 caatttctca tagtcttcaa aaatctaatg aaaagaaaat acacattaga
157451 gtgtaaaagc agcagtggat tctccgtatt aggctggctt gctttctttt
157501 tcaggagcaa attcccaact tctggccatt ttaccatcct tctttacatg
157551 tgaagacact gggggacagg gaggtcaaga attacaagag acatccttcc
157601 ctattttatt ttagttctgc aaattagata aaaactgagt aattttgagt
157651 ccttccaata aatcattttg aataaaactt ctagtaaaag ttgcaagaga
157701 actcattta tgccatttta aagaaatctt tatgtaagta gccttgctgg
157751 tggctatggg tccacaattt gggaaaatat taaatacact taaggcttca
157801 cttggcaagc cataaagaat cagactgttc aattcactgc ataaacagat
157851 aaagaacgag gcaacctttg ttgcatgacg gcccaactag tctctctgga
157901 gcacttcact ctcaccggaa gctggggaca ctggtgcacg aagtcttctt
157951 tcctaacatg gtcaccaacc atggcctagc ccttcagttt aacacagagt
158001 gctggcatct ggggaggttc agcattcact tccatcaggt gtgggcacac
158051 agctcataga gcactgaagt gggaggaatg agcgcagcca ggacggagga
158101 caagagatca ggaactgaag agggtgacaa actcctagcc ctcggagagt
158151 caagtgcgag gggagagtgt gtgccgctgt gtaatgaggg caagctgtgc
158201 atgctgacaa tcaccgatag agaataaagt gaaaagtaaa aatacaaagg
158251 tgtagctcac attaaaatca cagtaattat actctttaat atgaatgact
158301 tatttattct atcctgaaac acaaggagaa ttttgtggat cattaaatgc
158351 atcagacaag ccttgtgata aatttgaata gtaaatataa aatgcaaata
158401 catgtatgtg gtatgaccta ctcccgagtc caccagcttt attactttag
158451 agtcatgcat catgtgctcc agtttcatgg catactgcta aagaaatatc
158501 agctgaaaga gtctgaaagg tttgaagggg catgagttct cagagctcgc
158551 attcaggcca atgcaggagc ttcagcagct gtgaaattac taaattacac
158601 aagaagtgat atatggatgt aaaaacaaaa ttaggtaaaa aaggagtcaa
158651 agagaatgaa tttattagtc tctcaaactg tcatgtatta tacctgaaca
158701 caaagcatta ctgcacaaca catttacctc attcattcta taggaaaaaa
158751 tagtaattag ttgatattgt agatttatcc acgttatctt agcctttttaa
158801 aaatttatt tcttataaat gtgacatcta atgaatcttt ccttaacatt
158851 ccatctagca tatatagtta ctgaacaacc aaactatata ttaacagttc
158901 atttcctaaa ttcaaaaata gacaatttc ttttctttt tctttttttt
158951 tttgagacca agtctcgctc tgatgccaag gctggagtgc tgtgacgtga
159001 tctcagctca ctgcaacctc cgcctcccgg gttcaagcaa ttctctgcct
159051 cagcctcccg agtagatggg attacaggca cccgccacca catctggcta
159101 attttgtat ttttattaga gacaaggttt caccattttg gccaggttgg
159151 tcttgaactc ctgacctcgt gatccaccca cctctttcag tctatacatt
159201 ttgggatgcc tctagcaata aaattattc tccttgcagt agaatgaggt
159251 tattagaggc tggggaaggt aggagggagg gaagatgaag agagactggt
159301 taacaggtat aaaaatacag ttagaagaaa taagttctag tattcaacag
159351 cacagtaggg tgactatagt taataattta ctgtatattt caaaatagct
```

```
159401  agaagagaag atttggaaag ttcccaacac aaagaaacga taaatatttg
159451  aggtgacggg catcctgatt accctgatgt gatcgttaca aattgtatgc
159501  atatatcaac atatctgatg taccccataa acatgtataa ttattttgta
159551  tcaatttaaa aaatcatcct cccctcacat tttacactta aaacaaatac
159601  tctagttgat tctgtggcta tttcctttat aacatgagga cataaaaatc
159651  acttttgatt ttataattat attgctaatt cctaatctta aattgaagga
159701  caactggcaa aaataaaatt tattttattt ataattaaaa gagaagtagt
159751  taaatatttg tgatttgaat gtgtgaagat atactattga taggcagagt
159801  aggccacacc ttcccagtat tcaggagtat gttgcaacct ttgtctagga
159851  tataaatgat tcagagactc cttgaggact attattaata tttgtttgct
159901  accactggtc catatgccta ttatgtgccc aactatactg catactgttg
159951  ggaaggcata aagtcatagt aatcatcaaa aatgtacttc tttttgtaag
160001  cacatgtaat ttaatttaat actaaagatt tcaatcaata aagatacttt
160051  accttaattt acttattact accataaata tcatatacac atgaaattgt
160101  tttttgcttt taatagatga agacaaaaaa aatccattca tcataccata
160151  tatataaata tttagaactt cttggtttag gcatcaataa tacaaatagt
160201  taagtgctgc tttaagacag cagattacat tcttgctgtt aggtgtcagg
160251  cactagactg ggtgatggag acagagtagt aacattaact aacacatgta
160301  aaaatgccaa aaatcccagt aaaaaataac tgtggctgtt gctaggatga
160351  ggatcagaga ctcccctttcc ctaagtccta gtttagatgc atgctgtcca
160401  acatagggcc atacgcggct actgagcact tgaaatgtgg ctagtccaaa
160451  ctgagatgtg ctgtaagtgt aaaatacaca tcagatctca aacactcagc
160501  atgaaaaaag gatgtaaaat agcttgatca tttttcactt catcttagcc
160551  aaaagaccga gaagcgatga tcattttcca tattgattgt acattaaaat
160601  aacattttc gtatgttggg ttaaatagat gtatattatt aaaattaatt
160651  tcacctgttt cttttaccct ctttgtgtgg ctaactagaa aatttaagt
160701  tacatagtgg ctctcatttc tggctggcat tatatttcta ctggacagca
160751  ctgaggtaga gcatctgaac caacactaga acaaaacata caaagttttc
160801  cttctaggtt tgagctatat tttactgtat aatgctgctt ctattgctta
160851  cacatttagt aaaagtatcg ttgcttttgg atggatctgt caccaccaaa
160901  tgtatgacac tgcattaggc attaggaaaa caagtaacaa cgattaaaaa
160951  ctaatactga gtgcttactc tggtactgtg ctgaaaactt taaatcccgt
161001  caaactccct caacaaccct atgattcagg tattattact atgttcattt
161051  tgcagtgggt gtagtaactt gcccagggcc actaaggagg caggtcttga
161101  agccaagcaa gcacgaagac tctaaagtcc atactgtgct cttaaccctg
161151  tgtcctgcag ataagattcc tgcctcttag ggggtgcaag ggccagccag
161201  aaagatacag acacaccata ataatacaag gtgaaaaata agagggagcc
161251  agagagagag agaagaaaga gagaaggggga gaggagggag aggagggaga
161301  agagagagga gagaggagag gggagagaga cagagacaga aagagagaga
161351  gaaagagaaa ggatgcatgt tttgggaggg gtaggattag ggaaagcttt
161401  ctaaagagtc atatttcaac caaatctcaa aaggatgagt tggattcact
161451  gtcagggaag ggagttgcaa gataaaaaat atttctggta tttttactac
161501  taagtaagac taattatcaa ccaagtaaaa tgatgtactt tagtgagggt
161551  ggggttctct tccttttgga gttacctact gcctcctttg atttgcaaca
161601  tcaaagcaag caggtgctag tcatttattg agcttcagag cacaacacga
161651  agagatgtga aaaggtgaa agccctgacc tcctgccatc tcaatttttcc
161701  ataaagtttc ctgatgacct ggtttccagg tagacaaatc aggagtatgg
161751  ttgaatgcga ctgatttctc ttgtggataa ttcacagggg caattgctca
161801  tagatctaaa agggagggag agagaaagtg ggaaagtctt taaaaatgat
161851  ttctacttac agtgtcgtaa ttttgttcta agaagtctgc taccaacact
161901  ttatgtctgg ttagtaaatc ctagaaaaag aaaaaccaag tgaaacaaaa
161951  ctgttatagc tattaatatt acaaatgtgt cttttctaag gtttaagaac
162001  atataaaagt tgcagaagaa catttttcatt tgcgccacaa aattattttcc
162051  attcctagct tagcctaaga tgtgaaatac aagtttgttt catgttagaa
162101  aagaaaaact ctggtgttaa acctagtgtt tcaaattcat attgttagat
162151  ttatgataga aataatttaa ctggtgaaac aaatggaact tgagatgagt
162201  taatttttt ttttttttt tgagatggag tctcactatg tcacccaggc
162251  tggagtgcag tggcatgatc tcagctcact gcaagctctg cctcccgggt
```

FIG. 5 CONT'D

```
162301  tcaagcgatt ctcctgcctc agcctcctga gtagctggga ctacaggcgc
162351  ccgccaccac atccggcttt ttgttttgt attttagca gagacgggtt
162401  tcaccgtgtt agccaggatg gtctcgatct cctgactttg tgatccaccc
162451  gcctcggcct cccaaagtgc cttaaccact tttaaaatgg gcgcctcgga
162501  tactggaagc ataggactga catttagcag tgtcaaacca gtattgttcc
162551  tgctcttggg ttaatgggat gtaaggtgtt gtgcaagtta ctaagtagca
162601  caatccatcc tttcaaaatt gaagatgagt agccctatct tatggcagat
162651  ataaacttgc agaaaactga acaaagcatg aagaaacatt tgactgtctt
162701  caactcatac ctaaattata tccttaactc actttaatgt tgtaggaaaa
162751  caagcctcac ttaatccctt ttatatgctt agaggctaaa tgccctgtct
162801  aggtgctatg aaaaatttaa ttaaaaacat aacaagaatt ttaaagtttt
162851  ccaaaataaa ttcttttaat acatatttaa ttaaaatttc ctaaaagcat
162901  atagaaggta cacaacataa cttcacaaag aaaaggcaga taacaaccat
162951  aataaaaccc acttatttct actttaattt tttaaaaagt aaaatattta
163001  aagcattgtg tactataatt ttcaaattca aaaataataa gagtggctct
163051  taattcccta ttgctatcac acaacttgat caaccactgg gcctatcagt
163101  ggaaacatgg tgttttccc ccccagtgga gcagagcatt cattaccact
163151  ctggaactga agttctaaaa tggaaaacca tttacagggg ttccgttccc
163201  accccgtcaa aggtcttgat tcaaactagt tcctgcatca ggggacccttt
163251  gaaagagtaa ggtagttcca caagatcctt tgaggtccct actcttttt
163301  ttaaaggata atattggtgt catgctttca agcatccctc ccctaacatc
163351  atagaaaccc catgagcagt aatagaaatt ttctgagctg aaccagggca
163401  gagggacccc cctctatggg ctgcagcaga cactgtggat tgctgcaccc
163451  atgggagttc tctacctgct tcaactatcg tcagccttg aaagtgagga
163501  ctgggttccc cacactgcag gcccagcgca cacagcccca gtggcaacaa
163551  aaagagcagg ttgcagatca gtgctgcctt gaaaggttgt gtcatacatt
163601  agtgttaccc caaagaaaaa gggatcagga gggagttagg ttaaaaccaa
163651  cactttcaaa ttccaaggca agaaaaccttt gaaacagctt gaaaatccag
163701  tattaggaaa ccataatagg gtggggtaga attcctccag catatatata
163751  tatgctagat atatatataa tatatatata tatatatata tatatatata
163801  tatatatcat atcatggata cagccaataa acaatgcaca cattccctct
163851  ctcacgccca catttccact ccagtgtgta atgggattga tacatggata
163901  taccctcaaa tttatgtaca taataaatgt atatacaaac cacatataca
163951  tacacacagg cttatgtaca cataatacat agacaaatat aattgctgca
164001  ttatagatca cataactgag tgaaaaaaaa aaaaagaaac cacaaaaaaa
164051  acagctagga tcctacccaa gaaggaaaag acagaaaatt gtgaaggaaa
164101  ataaagttca aactccaaag aatttagaat ttaaaaacct taattcaaat
164151  agtgtactct ttcatcctac ctcctaacaa ttctgttttg agaggcctaa
164201  gttttgcata gtatattatg ctgaaaaatc tgatatctat attttttaatg
164251  aatactgctt gagagaaact tggggtagag tgagagagac acttaattgc
164301  agggacataa aaggctgagg agccagcgac agctgccgtt tagagggctg
164351  actgtgctgg ggagtgtacc gagcactttg caaatacggt ttctgatctt
164401  cacaagtccg tgaaaaaggg atgattttct tcatttcaga tgtggaaaat
164451  aaaactcaaa ggttaactaa attgctcaag gacatccagc ttatcaggtg
164501  gcagagaaag acagaattca aaccacttct attatgggaa ttttttagagg
164551  gagggatgaa agagattatg gttgtatgga atcctttttg ggaaaagact
164601  tttggtagac aaatctatgc caaaataaaa aactaacaat gttacaatat
164651  taataactaa actgagcaac agtccctta agagctcaaa accaaaaaga
164701  ttaggaggtt ataaaaaaacc caaaccaat gccaaaatca agtcaatcat
164751  ccaaccaaac aaaacccttt gaaaccagct actttaaaaa aaaaagtgat
164801  ttatggtcat tgttacatta tattaaccat aagcatttgg taaaataaag
164851  aaaattggtg tttccaaaac tgacagcata ctagaaaact ttttatgatt
164901  atttagattt taaaggattg acttaaattc aatggaaaat tggcttaaat
164951  acaaatcaaa acaccattta tttttgtcat tcaatattgt tgctgaaaat
165001  taaattgggc tgaatatatg acagcaagaa attactatca agtacatctt
165051  attctatcaa atgtttaaaa acctttgggg aaattttcag aaatacatat
165101  taagtatttg ctttcctcct ctattggcgt tgttctatg tttgtaatta
165151  tgtgaaggct tactttttt taaaaaatga atttacttgt ttccatgaca
```

FIG. 5 CONT'D

```
165201 gcgaagagcc atctgatagg aaaggggaaa aaaatgggac tgtagtgtct
165251 attattagca aacacctcct tagtagttta gacacagaca ttttggtaga
165301 aagaaatgga atcatccttt gtatttaatg tcattcttca tgttggatgc
165351 aaccgaggcc tatctcacca ctagctctag atccaccttt tgagggatc
165401 atctctagcc gctgtacaat ttttgtcttc cggggtgaga aacagccact
165451 cctgggattt ccaacactcg gagcccggag ccatgctgcc ctcaccgccc
165501 ctcccttcac ccagcagtca cttccaggag tctgttccca agcccttcct
165551 ccttcttttc cttccttcct tccctcactc ggctgttctc ccgagatttc
165601 agtttcctta ctccaagctt cccattcttc atactccgcc tctcgttaac
165651 tccccttctt cccttcccct tcttttcctt gccctttct gtctacccag
165701 acctcccctg tgggctcctc ctctcttccc tgttttcttc agggagacca
165751 taggacgctg gcaggctgaa tggaggcctg tggacacccg agcaggctgc
165801 aaactccttc ccttcaaacc cggacgctag aggccttgtg tttgttgcag
165851 ttttgcctga ggctttgggg aaatgatggc attgcggttc ctttcctctg
165901 atgtctcggg caattcagtg cttgtccgaa acccgcacac cctcctgctt
165951 acgacaacaa aagtgccaca gtggccgggc gcagtgactc acacctgtaa
166001 tcctggcact ttgcagggc caaggcaggc ggatggcttg aggtcaggag
166051 ttcgagacca gcctggccaa catggcaaaa ccccctctct actaaaaatg
166101 caaaaattag ccgagcatgg tggtatgcgc ccgtggtccc agctacctgg
166151 gaggctgagg tgggaggatc acctgagcct gggaggctga ggctgcaatg
166201 agctgagatt gcaccactgc actccagcct aggtgaggga gtgagacctt
166251 gtctcaaaaa gtgctgcagt taactgggct taccctgctc ctaggcagct
166301 gttaacaacc agctgctgtt gcttaagcct gccctggaat ccaccccag
166351 cccaccccaa gtggcttcca aatattccca tcattctcaa acagtattct
166401 ccctccagag ttcttgtcaa ttaaattttc ctttgcatcc tgtatttcca
166451 gagatggcct ggttgccttt atagatcgtg tgccaggcag ctgccaggac
166501 ttgcctcccg cttaaccacc caccactctt tggtcttctc catcacaaca
166551 aatctctctg acggcccagc ctgcaggctc cgcctccagg gagaccacgc
166601 cccgtccctc accctccgcc aggcattctt ctccctaagt cccagcttcc
166651 ttctgcccca ctgacatctc ctacccttta ccactctctg acactctctc
166701 acactttgtg tcaccatgtg acctaatata cctttcaaca gatttatggc
166751 accttctcag aacaggctgg gtaacttcct agtctgcaga taataggtag
166801 ttttcagcag agcaaaccac tgctttcccc ttttccacc tctggagagc
166851 tatttaaaag aactatttac catctaagtc ataggcaact ttcaatcact
166901 gttcataaag taatacgatt ggagtatgta ttaatattag tatatggact
166951 atatcgatat tattgaaata catatttaag gtaatatata aaaaataaaa.
167001 attcatacat ggattacaat taagtaaaac ttgtaaaaaa aagttacata
167051 cgtatatcct gaaaaagta taaattaatt tggagttatg taaatagaac
167101 aattaaattg ctaaaatgct tttgaagaaa tgaatctgaa tacatatata
167151 tatatatata tatacactt taaatgagtc ttacctactt tttaaacctg
167201 aaaccctatt tttttcaatg atgctgttac attgtcagtc tatagtattt
167251 tttgaattcc tcttctcaaa cagcttcaga gctgatttgg tagacattga
167301 agaaaatcat atctatttta tttctatttta tatcttaaaa ttagttttct
167351 tataattatt atccctcccc aaataattct agctaacttg atcacccact
167401 ttatacacta accggaatgt caaataggct tttgtttcca aaacttttat
167451 ctgcccttga atgataaaag tttgccatta ttgaaaaatg agcatgtaat
167501 acacattgat accaacttca aaatatgtta aataatagca ggatcataag
167551 cctaagtaac tggttttcta aaatagaaat ctcgaatgta acatcactca
167601 ttagatgact aagttttggt atgttgtct gcaaattagc tgcactcttt
167651 tctgatatat tctctgaaca ttttttgat gataaatac agaaaccaaa
167701 agtaaaatga ttgtcagggg ctggagggag gaggaaatgg ggagttatta
167751 tttaataagt atagaggtag agtttgaatt tttcaaaata aaaaagttct
167801 ggtagttggt tgcctaacaa tgtgaatata ttgcatccta cgatttccta
167851 catagtgaca aagtagataa tacatgatca aactatagat gattatgaaa
167901 caacgacaat ataatttctt actattttgt ttcaccatgt ggacatttaa
167951 aaatttcatt cataaaataa catgatgtcc ttcatattca aagatgtaat
168001 tctccatctc ccttcactac ctagttcctt tccccagaat taatcactgt
168051 tgctgtttcc tatgcatcct tgcagaggta ttcagtgcat atgtacctta
```

FIG. 5 CONT'D

```
168101  agtggaagct tatgcccttt aatctgtttt taacataaat gacagcatgc
168151  cacacacaga gcactacata ttcctttccc acgtaactgt atatactgga
168201  attcactcca tttgagcttg tgacaaatat tttgagttgt tttcctgcaa
168251  taggacagac tggcctcata gactgcattc tatttacaga ttcctcttat
168301  gatccacatc atacatggtt ggctacactg aggcctaaga agtaaaattt
168351  cttgcttttt aaaattaaat tgcctcttca ggggccaagt gactataaat
168401  tgacctagct gagttggaaa aaaaaaatta ccttgaaagt agcaaaggca
168451  tctgaagcaa tatcaaatgt tgacaactcc acgtacttaa agaaatctct
168501  gaattgatta gaaaagagga tgattttggc aagtggttca tgtcgaatac
168551  attctctcag cataatccca caacgtaagg caatctgtgg ggcttcatat
168601  ctaaagcgta aacaagagag aaatagagaa ctctgttatc ctattaaaat
168651  aatattaatg gcatcaaaag aaccatttca atactgctat taatggaagc
168701  atacatacca tttgtcacga ttcattcaat atccactgaa gatctactat
168751  gtgcctggca ctattgcaga cgtattctgg aatttgagtg tattctgaaa
168801  cacttagata tactcaaata tgaacatggt gacagctggg ggtgggggga
168851  tgaggcagaa tgtaaacaat gaaaagataa tttcatacac tgagaagggc
168901  tgtaaaaact gttgacaata aaatacgcca cattataaag gtgactaaat
168951  tgtgtgtgtg tgtgtgtgtg tgtgtgtgtg tgtgtgagtg actacttaag
169001  ttactttact ttagactcaa ggaaaaggca aaatgttcca ggcaaaggga
169051  aaaaactgtt caaaggctcc atggcaagaa caggcttggc gaaacagaga
169101  aggaggaata aagcctgtgt gattcgattg tagaggaaga accgtgagtg
169151  gtgtgaaatg aggcaggggt ggagagaagg gcaggggcca gatcccagat
169201  cagatacagc tttgtcagcc aaggtaagca gttggtttta ttttaagtgt
169251  aatgggaagc ctttggagag tttaaagcaa gaaattgaca agactaactt
169301  atgctttaaa aagatcactc tggcttcttg ttgagaatgt ctgtaaaaca
169351  gcaggagaca tataagaaca ggagcagaac ccaggagagg gaacggggc
169401  ttggcctggg gtggcaggag cagaacagag gactgtgggc aggtggtgga
169451  tactgttcgg aggaagagtc aacaagactt gctgatgatg tagctggagt
169501  tgggtgaggg aataaatttg gaaactgaga attcacgaat gattcctatg
169551  tttttggctt gaatcactgg gtagatggtg gtgctattta ttaagatgaa
169601  taaactagta gaggaacaag ttagtaaaga aattaagagt ttgtggttga
169651  ccacattagt tttgagatgg ctgatatcta agtagaaagg tctccttggc
169701  agtatgatac acttatctgg actttaggaa aaagatagga gagacctata
169751  taaatatatg atttgcatgc agtaggtggc taatacatag ctgtggactg
169801  attgactcac ttaaatccta agtggaatca tggctcacag caaaaaatat
169851  gctagacaaa cgaaacgtct actgtgggaa acaattcagg actggcatac
169901  cagattggtt ccatttctaa tacaacaaca atctctcaaa gtcaaattca
169951  gtctctaagt aagtttaaga tatattccag tgtgtgataa gatttcaaga
170001  aaatgaataa tgcttagccc aagtacaaca agccctgtat tgaaataata
170051  cagttgacaa ttgtgtggta aatataggaa gaatagaaca aagaaagata
170101  tagttgtgat acactgggaa gtgagcagaa tatagggccc cctccaaaaa
170151  aaaaaatctg gtggggcgtg actgctcact cctgtactcc cagcactttg
170201  ggaggctgag gtggatggac tgcttatgct caggagttcg agaccagcct
170251  gggcaacatg gctgacttta caaaaaataa aaaaataaaa aatttagctg
170301  agaccctgac tttacaaaaa ctaaaaaaat tagctggaca tggtggcaca
170351  cgcctgtagt cccagctact caggaggctg aggtgggaga ttgcttgacc
170401  ctggaaagtt aagcgagact ctgtctccaa aaataaaaat aaaataaaat
170451  aaaatctgac catattttta aagagatatc attgaccatt tcaactgaat
170501  actagttttt atggaacttt tatgatacta taaaactttta agatatttta
170551  ttactcatca actactagta acaacatttg ttgaacaata agtaatgtac
170601  tactctttat aagattatag aattttcatg aaagacagat tcaagaataa
170651  agattcaatt gaggaaatag actacttttcc aatatcaaat ttacaaatat
170701  tagtagaaga aacagcaaac aaagatacca gggtggtatt tattcatttt
170751  tgtcctgttt atgcagaatg atattcacaa atattgagta ttccctgaat
170801  aactcatagt aacattaaat gctgatacat tcagatagtc atgattcttt
170851  gtagaatata aggaatgcca atttatagtg ctagcaattt ctcttattag
170901  aaaaacctga aactcagcct attggctcac aaggaacagt tgtcaggtgg
170951  ggtttttatta aagatgttgt aaagaggggt atatgttctg aaatgtaaag
```

FIG. 5 CONT'D

```
171001 gagaaaagca ctgtcattta ttgatagagt actcaagaga gtataaaata
171051 aaggctgttg gcctagagaa agaatctaag ggaaggacaa ttaaaatcca
171101 gacttattga tcagcaagat atatgtggat ttttgtaatt tggccctaac
171151 cttaactttt cagtttcatc tcccatcaca ttcgttattt ccctggagcc
171201 cctcattccc tcaattggaa tgcccttctt acattcccac aactcagatg
171251 cttctcatct ctcaaggctt agttcaaatg ccatctcctc cttgaagcct
171301 ttcctaatca ctacaattca ggattattct ttctgccctt cacactcaaa
171351 taacagcttg tctgtaattt ctctttaaca ctttttcat tctgtattat
171401 gttatactgc agtaaattgc tataggtcta ttttcttcat tacaatcaat
171451 ttaattgttg gggatatgtt ttacttatcc tgttaccttc tcctctcctc
171501 ccctatcccc atctccattt ggtgtctatg tcatttattg ctactttctc
171551 ctgtccctac cccagtctcc gaagagtgcc tattataatg ttttcacga
171601 agcatgcata taatgaattt aatgaacctc aaactgaaga aatgtcttaa
171651 tactagagta ctctaatgag agtcaaactc tgacgtatac aaaatatgca
171701 tcatctctgg ccaacatttt ctcatttctt aattcaattt ccaaactaag
171751 accatctata aaaagtttcc actctaactt tgggtataa ttagttctct
171801 ttttcctttc atttcgtgaa gcttattgaa accatctgtg atgcactgac
171851 agtttattct tgagaatcaa aagaatgttt ttaaaaaacc aagactcctc
171901 tgggtcagca cacttgtcat ttcatcccag cagtttgaca tctgtcattc
171951 tgagattaca acttcttaaa ttcagaaata catagggata tacagagata
172001 tatagggaat tctaattctc ctcagtactc tttaagtgat ttataattca
172051 catagatcat ttctacctga ctaccctcta gtatattgac ttttgatagg
172101 ttattgctta ctatttaaag aagtgctcca aaagataagc ttaggttaag
172151 tttcaaatcc cactaacatt aatatcctta ggtctgttaa agaatcaata
172201 tgtatcccac ctaatctatt ctactcatag ataagcttcc tgatggcaag
172251 gatcctgcct aattactgca ttttccacaa tggctaaccc atggcaggtc
172301 cccagtaaag gttaatctga tgaatgctga atcactattt tatagaactg
172351 aatcttatct tccctcttga tttgtaattt agatcatata gtctggacta
172401 taatgaactg tgtcagtgtg gagaaggcac tatctaggca tgcccatcaa
172451 ataatgacag cataatgaaa agtctctctc aaatttaatg aaagccaaaa
172501 tgtaagagca atggtctcag ctggcagtga gctacagtaa tcattacaca
172551 gaaaatggtc agaagaatga tcttgtgcaa gaatatttca atttaagaac
172601 aaagattaca ttatgtaagg gggaaaatga cttttgtgat tattgctgga
172651 agtaaacaag gccaggaaat acctggaaag cttttgtaaa atgccattca
172701 acaaacactt ggcctcctca atatagtcaa gaacgtatgt ttctaatcta
172751 gaaacatttg ctgactaaaa ataatgagtt aggccaggca tagtggctca
172801 tgcatataat cccagcactt tgggaggcca aggcaggagg attgcttgag
172851 cccaggagtt tgaaaccagc ctgggcaaca tagtgggacc ctgtttctac
172901 aaaaaaaaaa aaaaaattaa ttagctaagt gtggtggcat gcacttgtag
172951 tcccggctat ttgggaggct gagtcaggag gatcacttga gcctaggagg
173001 ttgagactat agtgagctgt gatcacagca ctaccttcta gtatgggcaa
173051 caaagcaaga ccctgtctcg ataaataaat aaaataatga gttagttctg
173101 tccaccaaaa aggcctagaa gcaataacaa tccaatgtca atgagcaccc
173151 ctagcaacca gattgtagtc tctaagaacc atttctctct aaaaagaacc
173201 aacatccttg gtagaaattt caggtctttg tcagcaaatg tacaagttgg
173251 gtggcatatc tcgttacacc agaaagcaaa gaagctctca gaaactattt
173301 tagtgatgtt aagagatatc acctagaagg ggccacagat ggccaattga
173351 gcattaaaaa aacatgtgta gaactaaata agacatatag aaaacattaa
173401 atccattagt tcatcagata ctagaagagt gtgtgtctct gtacatatat
173451 aaatatatat atatatttat acacacacac atatataaag gcaggggag
173501 ggagggaaat aactcattag acaccgatga agttcctag gatatcttat
173551 ttttctctaa aatgataatt aaaagaaaag aattgagcat ttattctgcc
173601 tctctggtat gaattatact tcagagtatt ctaacacctg aagctgtggt
173651 gggtgaatga cagtattctc tataaaacta ctttagccaa taaaaaatac
173701 aaaaggaatg acagaattca aaattacctt tttgtcacct ctagcaaaat
173751 gacggaatca ggcaatgttc atcaatggat ggtaaaacaa ttaagtttaa
173801 ggttgatggg aaactttata gtggattaga ctgtcaccaa ctgaacccat
173851 tgctcagtct tagcattact aaaagtacat ctcctaatgt gatgaaatat
```

```
173901  gaactacata gcaccatcta caaaataact gccaaaatga aactgcttaa
173951  aatttttat aataaactta aaaaaacagg ataattggga gaaatttatg
174001  attttaacat cagccttctg gaacatagtc cactggccac agttctttat
174051  ggatcactga gagctgttca gtgacctcat tctcaagttc tctcagtacc
174101  ctggaatgtc atttgcctga gccagaagac aaattcattt agagtgagta
174151  agtccttatt tataatcttt tcatagaact tgggctccaa atacatttta
174201  ccatgtttaa taccacatat ccagataatt ctctttgata cacaagtatc
174251  aattgctttt tgtcttatat tctttatggt tagacttagg ttctatacag
174301  aatgttacta tcatactctc atttatatta ttgtttgatg tgtaaatgta
174351  ccaatcaagt tatgccctag gttttaaagt gacttcacaa ggataattcg
174401  gtaaaaatcc tgacttttaa gaagggctaa atctctagca ttcagtgcta
174451  aattagaaaa tggtaacagg ggctgggtgc ggtagctcat gcctgtaatt
174501  ccagcatttt gggaggccga ggcaggcaga tcacaagacc atctggctaa
174551  catggtgaaa cctcgtctct actaaaaata gaaaaatta gtgaggcgtg
174601  gtggcatggg cctgtagtcc cagctactca ggaggctgag gcaggagaat
174651  cgcttgaacc tgggagggag aggttgcagt gagccgagat cacgccactg
174701  cactccagcc tgggcgacag agcgagactc catctcaaaa aaaaaaaaaa
174751  agaaaatggt aacaggtaaa actgattatg gtacaactgt tccactaccc
174801  tgtcctcagg agcatcaaca attcccgctc ccttcacatt tgaacagtcc
174851  tcgaatcttc ttaaaggtat attaatggta aggaacatgg gatttagtgt
174901  cagatctgca tggaaaacta ggctctgtca tgtattagcc atataacctt
174951  gagcaatatc cttactctct ctgagtttca gtttcctcat ctgtaaaatg
175001  gtaaaaaaat aatatgtagt cctcatagta ttggaaagta aacaacataa
175051  cataagtaaa gacattacaa cagctggcac atagcaaaca atgagtaaat
175101  ggtttataca aaacaggatg tgaaggaatg agttaaaagt ttgggttgaa
175151  aaacagaaga ataatcattg caatagagaa ttaaaaccag aggtgtagtc
175201  cccaaattgt cactaatgat ttcgtttgga gagattatgg gatgtacttt
175251  cttttctgt tctacatttc taaaatgttt tagttttaa ataataacca
175301  tgtattactt ttgaattgga agaaatggaa aatgttttca aatacgcatt
175351  ctcttcattc tcagtatctc cattaaagtt ctgatgataa tctcttcccc
175401  agactcttcc aagctggaat ctcagcctcc caccccaagc tatttctat
175451  gttgccacca gaactcctca tgtctagtcc ctggatgact ccatgttgcc
175501  tacagaatga cattcaaact ccctagtagg acttggaaag ctcttcatca
175551  tctggtctca gtatttccaa cttcatacgg cacccttccc tctgactcac
175601  acagaactct agtcacacca gaattcttgt cattctccaa acacataaaa
175651  tctcttatat actttcacct ttctgtgggc cgaaatggca atgaacaaag
175701  tgatcttaga tagcacatgc tgaagatgac agaaccccct gatgaactag
175751  aacatctgct ctgcactatt acatgagaaa tatacttatc ttgttgtgga
175801  gccaattcac tttgggggtct atgtgttata gaagctttgt atcccctaac
175851  taatagatga tacaaggatc tttccctttc cagagctgaa agaaacaatt
175901  ctccagtaaa acaattattt tgtacccaaa acaaaagtaa tcatagtaca
175951  ctactttgct cactagtgaa taataactgt gcaatcataa taatctaaat
176001  gtgattatta aaatttaaaa ttatgataaa gtttattagg aagataaggg
176051  aaaggaaata gaataatggt ggcagtaaaa agactatcat ctagtttatc
176101  ttgtcaaaga tactgcttaa aattgataag tgaaaaatta gtataagccc
176151  attatttgta acacagaggt aaatatatga tgaaaacaat gatgaacaaa
176201  taaaagagat aaaagtggtt gtctttgggt aataggactg aaaaatagag
176251  aagaaagagg caaagaggcc aggcgcagtg gctcacgcct gtaattccag
176301  cactttggga gtctgaggca ggcagatcac ttgaggtcag gaggtcgaga
176351  ccagcctggc caaatagtga aaacctgtct ctactaaaaa tacaaaaatt
176401  agccatgcgt ggtgatgggc acctgtaatc ccagctaccc gggaggctga
176451  ggcaggagaa ctgcttgaac ccaggaggca gaggttgcag tgagccaaga
176501  tcgcatcact gtactccagc ctggacaata gagcaagacg ctgtctcaaa
176551  aaaagaaag aaagaaaaga aaaagagac aaagaactgc tatttattga
176601  tatatctgat ttttaaacta tgtattattt tgatacaatt aaatatttaa
176651  aatgtacaag agagaaaatg aacacaggtg agatggacta ggtatgaaac
176701  agcagaattg aaaacaggaa tacaataaaa taaagagacg tcctggtttg
176751  agatggtgga gtagaaagac aaggggagga agaagatggt ctgctgtcct
```

FIG. 5 CONT'D

```
176801  caagctttgc tacacctaga tctccagtct ttatgattca gagtagcctc
176851  caaatgccca agaaacattt ataaataagt atacataaaa ataataatca
176901  gggattctat cacccacctc gacttcagtt ttatggcttc cctatagacc
176951  catatacatt caccttggca gatgctagct actggaaaaa ctctcatacc
177001  tgtatttcat ttcccagaac cagaatatat atgtgtgtgc ttatgtgcgt
177051  ggtgagggca ttcaatctca tgcaagcagg aaaagggtaa gtgggcagct
177101  aggaatagg  cagatagga  agcataagca atactgtaat aggaagagac
177151  agaaatagca gaaatgtgga ggaaaggaag gcagtaaatg gaaacataac
177201  atttagaaac attaaggtgc aaagaaagga ttttgctgca gtaatcatag
177251  agacagatct ggagggctga cctcacacat gacaaatacc tttactgcag
177301  ttccaaaagg gaactcatca tatctcaaat gagactaatg ctatgcactt
177351  ttaacaacta ttaaaaactt agccctactt gaaggaagc  catgtaccta
177401  ccctttgagg agcataaaca ggatatgagg atgagcacta atatactcca
177451  cagtaggact ccgagtgcct atctgtcttc tcaagatgtt gttaaatatc
177501  tgggtcacat cttttttttcc ctgttaaaga aacaaacaga aattaaattg
177551  tacactctaa atggatgaat tgtatagtat gtggaatata tacatatata
177601  tatacacaca gacagaaatg gtaccatcct ttctaatatg caaaaaaacg
177651  ttaacttact cttcccatag acccctaaca agctgtgctt gcaaacacag
177701  tctacaaaat ggatgcagct ccttgccaca ggatgtgtgc tgggggaaat
177751  ttgaccaacg agaaatccat ttcccacaga gcatggaagg acataaagtg
177801  aatatgacag aactgaattc tttgttttt  cactgtctac ctttatgcaa
177851  gaaaaaaatt atgattatca ttttaaacc  ttcatgaata aggaaggaaa
177901  acagaagaag aaaataagat tttagtaaaa tgtaggttag aaccaaattc
177951  cttttctta  gatctacttt ctagtatttt ttgctttcac gttatcactt
178001  tattcactgt tcttcaccct agtgccttga cttaaaaaat aaagtgggtt
178051  ttccattagc tggaaatatt tgatctaggt gatcataaca aatcacatct
178101  agcctagagg aacagaagag atcaccgaat cagtgagaca gaggaaccag
178151  atatgcaatc atggataggg cttcttagag tcctcatgga caagacctgc
178201  actctcatac accttacaac ctgtctagcc tggttttcca aaagaaatct
178251  tggactggac ctgagtttac tatatgaaaa ataagtacaa gaatgactga
178301  tatggtttgg ctctgtgtcc tcacccagat ctcattacga attgtaatcc
178351  ctataatccc tatgtgtgga gggcaggacc tggtgcgagg tgattggatc
178401  atggggg gtgg tttccctcat gctgttctca tgatagtgaa tcagttctca
178451  cacgatctga tggtcttata tgggactctt tccccttttgc tcattcactc
178501  ttccttctcc tgctgccatg tgaaggtctg tgcctgcttc cccttccgcc
178551  atgattctaa gtttcctgag gcctccccag caatgtggaa ctgtgactca
178601  attaaacccc tttccttttt aaattactca gtctcaagta tttccttata
178651  gcagtgtgag aacatactaa tacaatgaca ttgcattctc aatcagtatg
178701  gccctagttc tggccttcat ctctcaacta aactatgaaa gagcttgctt
178751  cagttactgt ctccacttca aagcatcctc accctgcaga gtgagctagc
178801  tagaaatgca aatatgacca tgccatctct ctccttaaac acttcaacgt
178851  ctcccttttg cttagaaaaa agtccaatac aaaaaggcca ggcgcagtgg
178901  ctcacgcctg taatcccagc actttgggag gccaagtggg gcagatcaag
178951  aggtcaggag ttcaagacta gcctggccaa tatggtgaaa ccccatctct
179001  agtaaaaata caaaaattaa ccggctgtgg tggtgtgcac ctgtagtccc
179051  agctacttgg gaggctgagg tagaagaatt gcttgaaccc gggaggcaga
179101  ggttgcagtg aaccgagatc gtgccactgc actccagccc aggcaatgga
179151  gcaagacttc atctcaaaaa aaaaaaaaa  aaaaaaaga  gacagaaaga
179201  aaggaaagag agagagagag acagaaaaaa agagagagaa agagaaagaa
179251  agaaagaaa  gaaagaaaga aagagagaaa gtccaatacc cttcaatgac
179301  ttgacagcag ccaacttttc cagtctcatc agctaactat cacttccaat
179351  tcctacatca agttctatta gtaccaaatt gctgcaccac atatacacaa
179401  catttatgg  ttctatatct ttgttgatgc tcttccttt  ttcatgaact
179451  ctgtcattct ttaagattca gttcaggagt tttctcccct gggatgagtg
179501  cccctctctg tactacaacc atgtcctttg ccacatcgat cagtacctcc
179551  tctttcccac tacctctacc tccaccttca cagcagcaaa tacttactga
179601  gtgcttactc tgtgccaggc acttatgcta agagctttac aggtattatc
179651  caattttcac aacaacctta ttttttttaaa tttcatattc tttttgttat
```

FIG. 5 CONT'D

```
179701 tttttttctg gcatgcatac aaccaccttta taatatacat attataaaaa
179751 agaaattaag gatgtataat atatgtttta taaaatgtac aaatgtaaat
179801 atgtatatat acatattata aataaggaaa ttaaggatta ttgagattgc
179851 ctagatctca ctgtcctgtc agatactgat aaatatctac aagcactaac
179901 accatccaag aaaacatgac ctcaacaact gaactaaata agacaccagg
179951 gaccaatcct gggacaatag agatatatga cctttcagac agagaattca
180001 aaatcactat tttgaggaaa atcaaagaaa ttcaaaataa cacagagaaa
180051 gaattcagaa ttctatcata aatttaatac agattgaaat aattaaaaat
180101 aatcaggtag aaattctaga gttgaaaatg caattgacat gctgaagaat
180151 gcatcagagc ctcttaacag aactgatcaa gtagaagaaa gaattagtga
180201 gcttgcagac aggctatttg aaaacatgca gttagaggag acaaaagaaa
180251 aaagaataaa aaacaatgaa gaatgcctac gagatctagg aaatagtcta
180301 gaaagggcaa atctaagact tactgacctt aaagaggagg tagaaaaaga
180351 gatagggta gaaaacttac tctaagagat aatatccgag aacttcccaa
180401 acctagagaa agatatgaat attcaagtat aagaaggtta tagaacacca
180451 agcagattta aaccaaagaa gactacttca aagcatttaa taatcaaact
180501 cccaacatca aagaaaaaaa aatcctaaaa gcagcaggtg aaaagaaaca
180551 aataacatac aatggagctg caatatatct ggcagcagac ttttcagtgg
180601 aaaccttaca ggccaggaga gagtggcatg acatatttaa tgtgctgaag
180651 gaaacaaatc ttttacccta gtatatctgg caaaaatacc cttcaggcat
180701 gaaggagaat taaagacttt cccagacaaa caaaagctga gggatttgat
180751 caatactaga cccatcctac aagaaatgct aagggtagtt ctccaacctg
180801 aaagaaaagg atgttaatga gcaagaagaa atcatcttaa ggtataaaat
180851 ccactggaaa caggaagcac atagaaaaac acagaatagt ataatactgt
180901 aatggtggtg tgtaaactac tcttgtctta aggagaaaga ctaaatgatg
180951 aaccaaccaa aaataataac aacttttcaa gatataaaca gtgcaataag
181001 acataaagag aaacaacgaa aagttaaaaa gcaggggag gaagttaagg
181051 tgtagagttc ttattagttt tctttctgtg catttcttta tgtaattagt
181101 attaagttgt catcaattta aaacaatggg ctataagatg gtatacgcat
181151 gcctcatggt aacctcaaat ataaaaatac aatggataca caaaaaaata
181201 aaaaacaaga aattaaagca tagtgccaga gaaaatcaca ttcattaaaa
181251 ggaagataga aggaagaga agaaggaaga gatgactaaa aaacaaccag
181301 aaaacaaata acaaaatggc aggagtaagc ccccacttgt caataataac
181351 attgtatgta aatggactaa agtctgcaat caaaagacat aaagtggcta
181401 cttgggaggc tgaggtgtaa ggatcacctg agcccaggag gtcaatggtt
181451 cagtgagctg tgattgtgct actacactcc agcctggatg acagagtgag
181501 accctgtctc aaaaaaaaa aaaagaaaag aaaaagaaaa agacacaga
181551 atggctgaat ggatgaaaaa aaaacaagac ccaaatgatc tgctgcctac
181601 aagaaacaca tctcacctat gaagatacac atggactgaa aataaagaca
181651 tggaaaaaga tattccatgc taatgaaaac aaacaaacaa aaccaagcag
181701 gagtagctat acttacatca gacaaaacag atttcaagac aaaaactgta
181751 agaggagaca aagaaagtca ttatataata ataaaggagt cagttcagca
181801 agaggattta acaattgtaa atatatatgc accaaacact agagcaccca
181851 gatatgtaaa gcaaatatta ttagagctaa agtgagagac acatcccaat
181901 acaacaatag cagatcttag acctgggaca tgataacttt taccactgtt
181951 actcaacata atattggaag tcttagctag agcaatcaaa caagagaatg
182001 aaatgaaggg caaatattat tagagctaaa gtgagagaca gatcccaata
182051 caacagtagc agatcttaga tttggagcat gacaactttt accactgtta
182101 ttcaacataa tattggaagt cttagccaga gcaatcaaac aagagaatga
182151 aatgaaggc atccaaattg gtagggaaga agtcaaatta tccttgtttg
182201 cagatgataa aaccttatat ttggaaaaaa ctaaagactc cacaaaaaaa
182251 ctattagaat tgatgaacaa attcaataaa gttgcaggat acaaaaatca
182301 acatacaaaa atcagtagca tttctatatg ctaacagtga acaatctgaa
182351 gaagaaatca aaaagaaat cccatttata atagcaacaa ataaaattaa
182401 atacctagaa attaacttaa ccaaagaagt aaaaaaatct ccataatgaa
182451 aactataaaa aaatggatga aagaaattaa aaggacatg caaaaaagga
182501 aagatattcc gtgtccatgg attgaaagaa acaatattgt taaaatgttc
182551 atactaccca acgtaatcta caggttcaat gcaatcccta tcaaaatacc
```

FIG. 5 CONT'D

```
182601 aatgacattc ttcatcgaaa tagaaaaaac catcctaaaa tttacatgga
182651 accacaaaaa acccagaata gccaaaacca tcatgagcaa aaagaacaaa
182701 actgaagaaa tcacatgact tgactttgaa ttatactaca gagctatata
182751 gtaaccaaaa cagcatgata ctggcataaa aatagacaca cagaccaatg
182801 gaacagaaca aagaatccag aaacaaatct acacacctac agtgaactca
182851 tttttttacaa aggtgctgag aacatacatt gaggggaaaa gacagtcttc
182901 aacaaatagt gcagagaaaa ctgaatatcc acatgcagaa gaatgaaatt
182951 agacccctat ctcttgtcac atacagaaat caaatcaaaa tggattaaag
183001 acttatatct aagatctatg aaactatgaa gctactaaaa gaaaatattg
183051 gggaaactct ccaggacatt ggtctgggca gaaacttctt gagcaaaacc
183101 ccacaagcac aggcaatcaa agcaaaaatg gacaaatggg accacatcaa
183151 attgaaaagc ttctgcacag tgaagggtac aatcaacaaa gtgaagagaa
183201 aacctacaga acacaggcct tctatgaaaa ggtgctcaac atcactgatt
183251 atcagagaaa tgcaaatcaa aactacaacg agatatcctc tcacgacagt
183301 taaaatgcct ttcatgtaaa cgtcaggtaa caactattgc tggtgaggat
183351 gtggggaaaa ggaacccctc atatgctgtt ggtaggaatg taaattagta
183401 caactactat ggagaataat ttggaggttc ctcaaaaaac tacaaataga
183451 gataccatat gatttagcaa tcctactctt aggtatatgc ccaaaagaaa
183501 ggaaatcagt atatcaaaga gatatctaca ctcccatata tgttgcagta
183551 ttgttcacaa tagccaagat ttggaaacaa cctaaatgtc caaaaacaga
183601 tgagaaaatg cggataaaga aaatgtggta ccctatacac aataaagtac
183651 tattcagtca taaaaggaa tgagattctg tcattgcaac aacatggatg
183701 gaactggagg ccattatgtt aagtgaaata aaccaggcat agaaagacaa
183751 acatcagatg ttctcagtta tttgtgggat ctaaaaatta aaacaagtga
183801 actcatgaaa atcaagaata gaagcatggt taccagaggc taggaagggt
183851 agcaggggag tgtgtcaggg tgagatgggg atggttaatg ggtacaaaaa
183901 acaatagaaa caatgaataa gatctagtaa caccaaggat aaatgcttga
183951 gaggatggat acccaatttt ccatgatgtg gttattacac attacatgcc
184001 tgtactaaaa tatctcatat acactaccta ctatgtaccc acaaaaatta
184051 aaaagaaaaa aagagaaaaa agaaataaat aaaaacccat gctctcacga
184101 ggtcaggagt ttgagaccag catggccaag atggtgaaac cccgtctcta
184151 ctaaaaatac aaaaattagc taggcttggt ggcacgcacc tataatccca
184201 gctactcagg aggctgaggc aggggaatcg cttcaaccca ggaggcagag
184251 gctgcagtga gctgacatcg tgccattgca ctccagcctg ggcaacaaga
184301 gcgaaactct gtctaaaaaa aaaaaaaaaa aaaaaaaccc atgctctcca
184351 aacaccctcc ctccaaaacc caaccccca tcaaagccca aaaaacttaa
184401 tagtatgaaa aacaaacaat ctgccaggca tggtggctca cacatgtaat
184451 cccagcactt taggaagcta aggcaggcag atcaccagag gtcaggagtt
184501 cgagaccagc ctgaccaacg tggtgaaacc ttgtctctac taaaaataca
184551 aaaattagct gggcgtggtg gtgcatgcct gtaatcccag ctactcggga
184601 agctgagaca caagaattgc ttgagccctg gaatgagctg agattgtgcc
184651 actgaattcc agcctgggca acagaccaag atcctgcctc aaacaaacaa
184701 gcaatctaat tagaaaatgg ataaaaggct gggtggggtg gctcatgcct
184751 ataatcccag gcaagaaatt actttggaaa gctgaagcag gattacttga
184801 gccaggagtt tgagagtagc ctgggcaaca tagcaagacc ccatctctac
184851 ttaaaaaata aaataaaaat aaacaaaaca gagaaaatgg ctaaaagaca
184901 tgaagacaca ttttaccaaa gaggatatac agatggcaac aagcacataa
184951 aagacgttca acattgttag ccattaggga aatgaaaatc aaaaccacaa
185001 tgaaatatta ttacatgcct atcagaatgg ctaaaataaa aaatagcaac
185051 aacatcaaat gctggcaaga atgaagagaa actgtactca tacattgtag
185101 tggaaatgta aaacagtata gccaatctgg aaaacacttt agcagttcct
185151 gaaacagcta aacatgcagc taaccataac agcaattgcg ctcttggcat
185201 ctatcacaga gaaatgaaaa ctatgttcac acaaaaacca attagtaggt
185251 gaatcttcaa tttaaaagaa tactccaaaa tcagttgctc tcataatttt
185301 aaaacactaa aaaatgttta taggccgggc acgtggctc atgcctgtaa
185351 ttctagcact ttgagaggcc aagcctggag gctcagttga acccaggagt
185401 tgagaccag tctgggcaac atggtgaaac cccatctcta caaaaaaata
185451 caaaaattag ctgggtgtag tggcacatgc ctatagtctc agctatttgg
```

FIG. 5 CONT'D

```
185501 gaggcttatg tgggaggatc acttgagcct agaaggtgta ggtggaaggt
185551 gtaggttgca ataagctgag atcatgccac tgcactctag cctgggtgac
185601 agcgtgagac cctgtctcaa aaaaaaaaaa aggttgaatt acataaattt
185651 tatttatact gatgttaaag actatatttg ctgtataaaa aaagatatag
185701 ctgtaagcat aaattgattt taaaatgaaa gaaatcatct gtttcgttca
185751 aaccttccta gaccctgcag tgtaatattg cagaataaat atcaaccctc
185801 tttgaaatgt cataggaaca tgttttcat acttcccagt gaaatgtcac
185851 aagaacattc catacagcat tccagtagaa atgaagctct gcagaactct
185901 atccaacttt tacatagagg aaaacattct tctagttcat tagcaaatgt
185951 gtgcaaaggc aaggaagcc ccctgtggat aacaaaagca ggttctgcta
186001 ccagggaccg cttcccaaaa cagaggaaag gattagaata gaaaggatta
186051 cagaacactg aaacaggtac aagctggtga ataatgatct ctacattaca
186101 cgttaatctt tgtagctatc aatttgtcat gccaaatcta actggagtga
186151 aaccttaact atttcaaaac cagtttttg caacccgcag ctgccagat
186201 ctcaagccct ggactcagaa gtggccagaa aaaaagaca gaaaaccct
186251 aaaatatat ttgataataa agaagcaaca tccagaaatg gcccaaatg
186301 ccaaaaatta gctggcaatt ctaaggttac atacaatgta accaataaga
186351 tcccaaacct gaagaagccc ttgtgtttgc tggcaaattc aaaaaagtca
186401 gctttaacat gaaatgctcc ataattattt gctgaatgaa tgaattatat
186451 atatggaagt attaactcaa atcaaataag aaaagagaaa aggagggaag
186501 aaagaggtgg tgaacagcag tcacagcaac cagaatgatt gctgaaaaag
186551 agcatccctc acagatagca tagatgagaa aagggaaatg agaaaagaag
186601 gcggagacta gaaaacaccc acttcaaaac acaagccatt gactttata
186651 tagaatatat ataagaatt ctcaaaattc agcaacgaaa ttaaaaaggg
186701 gcaaaagata tgaataaata cttcataaaa gaagagatat ggtagcaaaa
186751 atgtacatga aaagatgctc aacatcatta gtcattagag aaatccaaat
186801 taaaatcaca atgagatatc acaacccctt attagaatgg ctaaaacaat
186851 aaaacaaaac aaaaagttga cattccccaa cagccctact cctaggtatt
186901 tatctaagtg aaaggaaaac ctatgttcac actaaatact atacataaat
186951 ggttaacggc agctttattt gtaattgcta gaaactggaa atatgtaaaa
187001 tatcccacaa gtggggaatg gataaatgat ctgtggtcca tccatgcaat
187051 ggactactac tcagcaataa aaagcaacag actcctaata catggcaacg
187101 acatggatga atctcaaatg cgttatgctg acagaagcca ggctcaaaag
187151 gctacatata tatgattctg tttacccaat cttttgcaa tggtgaaaat
187201 ataaggactg aaaactgatc aatggttgcc agaggccgag gacaggaaaa
187251 ggagatgatt acaaagaggc aaaggagatt ttttttttt tttgagacaa
187301 agtcttgctc tgtcacccag gctgaagtgc agtggcataa tctcgactca
187351 ctgcaacctc cacctgccag gttcaagtga ttctcctgcc tcaacctccc
187401 gagtagctga gactacaggt gcacaccacc acccggct aattttgta
187451 tttttagtag agacagggtt tcaccatgtt ggccaggatg gtctcgggct
187501 cctgacctca tgatctgccc acttcggcct cccaaagtgc tgggattaca
187551 ggcgtgagcc accgtgccca gccggcatag gagaattttt tagggtgatg
187601 gaactgttgt tcttcattac agaactgtgc actaaaagg gtgaatgtta
187651 ctatttataa attgtatcat aattttaaa aatgaaaatt atagccagtg
187701 aagtcaggga cttctctatt cttgctggtg tgttgcgggg gagttgaggt
187751 gggtgggagc aagtggttgt gctgaatttc agtagcagaa gtggataggc
187801 agaacagtct accgggtgag gggtagccac tgaatggatt agtgagggat
187851 cttgctgggg actaaaattc aaattggact aatttataga tattgggaaa
187901 gatataggga atgaaactac aagctagctc aaagttgctc tcaaaaaaat
187951 ttaaatatat taaatttata tattacatga aatccatctg tgggaattta
188001 tatgggagat tatctccccc actgccccaa tatctttgtc attctatttt
188051 ctctgcaggc tggcttcttc tgtttcttta ggccacatag tgaaaaatac
188101 gaccactgat ggaaaactg catttactat ctttagcacc tggctaaaca
188151 ctggggttct gtctcagttc tagttccaga attcctgcag aaagcctctg
188201 gccctctttt ggtcagatat ccacttgcag atcattcagc tttgtgttgt
188251 ccagggtgtc atatcaccca aaatggttgt tccatggta accatgtgag
188301 tggagaagga gggagcattc cccagaaagc agagggagtg ggcagacaca
188351 acactttata cacagcacaa gcagtcttca tccttatgca gattacattc
```

FIG. 5 CONT'D

```
188401 cttaaaatgt ctggtacgat caaactaatg gtcactgtct taattttatt
188451 acaaacaatt aacaggtttc acatctaatt aagagcctga tgccaaatgc
188501 catttttaat cacccataaa ttatattcct ttataggata aaggccttct
188551 aaagcttata ttcattaagc tttagggcaa tagggtaatg ataacataaa
188601 atgccatttt ctatgacata gtatttccct acctgagatt gtaaattctt
188651 taatttgtcc agtgaggggc acaaaatata tacacaatca aataaaatca
188701 agaccaaaca taattaaata aaatcaatgg ctgacacgca tagtaagcat
188751 ttcaaattgt taaatgtata atgtacagtt aaagctggta ttttaaggct
188801 ttatgatttc tgttatattt ttacagtaat aaaaccaaag gtaaagagcc
188851 atttttttt cttttctttt ttctttcttt ttttttttt tgagatgga
188901 gtttcactct tattgcccag gcagaagtgc aatggtgcga tcttggctca
188951 ctgcaacctc ctcctcctgg gttcaagcga ttctcctgcc tcagcctccc
189001 aagtagctag gattacaggt gcatgccacc atggccacgg ctaattttg
189051 tattttagt acagataggg ttttgccacg ttggcgaggc tggtctcgaa
189101 ctcctgaatt taggtatccc aaaatgctgg gattacagac gtaagccacc
189151 acgcctggcc aagggccact ttaatcaggt ccagggaata gaaaaagatt
189201 attagaggat aaacatttac aaaatgtagg actacaaaat ggcttaatga
189251 aaagtggaaa agttgatcct ggagtgtttg ttttgctatt ttttttttt
189301 ttgagacagg gtctcattct attacccagg ctggagtgca gtagcacaat
189351 cttggctcac tgtagcctca accacctggg cccaggtgat tcttccacct
189401 tagcctcctg agtagctggg accacaggca ggcatactct gctaattttt
189451 tttattttt gtagagacag ggttttgcca tgttgcccag gggggtctca
189501 aactcctggg ctcaagcaat cctcccacct cagtctccca aagtgctggg
189551 attataggcg tgagccactg cactgggcct gttttgctaa ttttttttaa
189601 tgtagcgaga ataatcatt agggattaag ttaccataga agacaatttt
189651 ctgcttcttt gagctgctta ttcagcctga acagttcact ttgcatccac
189701 cctggttttg caaggcacac ctgcctttaa aatgaatgta tcagaccta
189751 caggcaatac attttccctc ctttgatctc ttatcacgtt gtgtttcaaa
189801 acatcaaaga gtctaaagct gtgtcttgaa tagtagccaa acctcaaaaa
189851 acacagctga gtttgatcct gagcccataa aaatcagaag ccttgcaaac
189901 tcagccacaa atcattttt gaacctcata atagtgtgct gaaatggttc
189951 ttttctgtct gcaattttaa ggcttaaagc attagataaa aatttatagc
190001 tacataatga gatttttatt taacccaaag gccgacctcc taactagcca
190051 ttattcacat gatgatagcc ggatcctcca gtattgtccc taccccagtg
190101 ggccactttc ctctagattc ctgacagaga agtaggtttg tcaaagattc
190151 ctgagtcagt ccctgccatc cagtttaagt cagtgctgcc agccaccatc
190201 actgctgtca gctcagggtt ccaaacccct gctcccagcg cccttcaacc
190251 cccattcatt gccttgtttc ctgcaactgc ttatttttc agcactcagt
190301 ttactccaag tgtagaaaac cacccccttct tcactcaact tgttttttgt
190351 tgttgttttt gtttttgttt tgtttggaga tggagtctcg ctctgtcgcc
190401 cagtctggag ttcagtggtg caatctcggc tcactgcaag ctccgcctcc
190451 tgggttcacg ccattctcct gcctcagcct ccctccagag tagctgggac
190501 tacaggcgcc cgccaccacg cccggctaat ttttatattt ttagtagaga
190551 tgaggtttca ccgtgttagc taggatggtc tcgatctcct gaccttgtga
190601 tccgcccgcc tcggcctccc aaagtgctgg gattacaggc atgagccact
190651 gcgccggcct caacatgtat tattagtaca aagttccttt acaaaggttt
190701 aaggtgaaca aaggataatc acagcacagt gcagaaacac cttcaagctg
190751 aagtctacag atcacttta tgaaaggttc ctcagtcttc ctgatcatct
190801 ttctccatga acatcttcct tttgtcatgg ttctggatac ctctctctcc
190851 ctccctccaa acctttctcc tttcttctat ttcctactcc tatcaacctt
190901 ggccaaagag ggcatttctc aaatttctgt tacttttctc tgccaaggaa
190951 atctaagctt ttttctttca gtctttcct tacagacatt gcctagagac
191001 ttcagccttt caaactaaca aaaaagccaa tcaaggtatc ttctaaacaa
191051 aaattcactt tttttctctg taaggaatgt gccattctcc taggttatct
191101 ggcaaaagct gtagtccatc cttaaaataa taattttcc tttctgttat
191151 caaaacatac cagaaatttt acagtcaaat gactgttctg ctatccaaag
191201 aagcaccagg agaggctatt cacgtactga aatcatataa tcatcacccc
191251 aaagagtttg aattatcttc taaacaattt actgattcct tcagaaaaat
```

```
191301 ggctcactgg tatgtcccaa taccttcttt tggtccaatt cttttacctc
191351 tgctttgata tctcattctc attactacat tcattcaaac aattcacaaa
191401 ttaacatgcc actaggtgtg gcaaacacag tcctcgtact caaggtaaca
191451 cagaagtggc tgtcccagtg caagccatga accaagagac atgggggtgg
191501 gggttctgtg tcgctggagt aagtctgaag tcagaaggaa ttttatcaag
191551 ctgtcagtag cttacataga tactttaggc ttgagaagga gagttgctgc
191601 ctgcaggctg atcatccatg cctccagttc atagagataa catagtacat
191651 ttctataagt aggctaataa tgctaggaat gctggctgcc tccttcctga
191701 aaatactgta tgtagttgga atgcttaaaa tggaactgta ctaaactttc
191751 actccttttc attcattcat ttattcattc aaccaggaag tatatatttt
191801 tctacaggct agagaaggat aacggctgca tctatggagt atcacattca
191851 cttataatta tgttctaggt atgtgtcacg tcaattgaat aaataaagtt
191901 aagaattgcc tatcttatta tcacaataac aaatcttcat aatagttttg
191951 aatcatcagt ttaaaaacgt attatatcta gtattttatt ctggagggaa
192001 ggcaagtata taatacattt tattttaaaa attaaagtaa tccacaagag
192051 taatcaattt aactctgcat ttgaaggctt aatcttcagc tatatggaaa
192101 attcaaatgt tcagaaagat acttcttttc tccaaggatt ccagagaata
192151 aaagtttact tgataaaaat gtacaagtct attttaggca attaaatgtc
192201 ttaattccaa aataattttt aaatgaactt cttctcaaaa ttttaatttt
192251 atatttgatg tgccacataa aagaagggga acttgcataa ctgtttctta
192301 cattccactt ttgttatctg agccaatgcc aaagaaagtt ataaggcacc
192351 caaagttttt ctttggtata ctcctcccta actcccccaat tcttggaaag
192401 cactttgaac ctatgaggtt ctgtggctgc tcaaagcttc tacaggtcac
192451 tgaacctgac gacatctcat ccctgactca ttcttcaaaa cataaccatc
192501 cttagtcata ttccttctag cactccactg caaattgggt taatctcata
192551 aactaactca agcgtactta tgaattaatg acgacagtag cttaatatgc
192601 tgctgttctc agagaaacaa gcaaaacaac agaaaattta taaaactata
192651 ctactataag aatagggaat cattttccta tttatggtca ctgaccaact
192701 aaatctaaaa aaaatcaagg gttataacaa aaacaaacca gcttacactt
192751 aactttagtt cctgagtttg agaaaaagag gaaatgaaaa aatactacta
192801 cttgacattt gtatacagtt tgcatttata tttagtgtcc ctatataaca
192851 caacatatat atgtatatat ttttatttag tttaatattt aaaacaatgc
192901 agtaagttcg tattattcct attttataga tgagaaaact taagctcaaa
192951 gaggttaagt tactgaccat gaaagagcag agctgggact ctaaacaatt
193001 ctaattccga gtcaagtgtg ttttcacta tgccacagct tctacaagtg
193051 ttcataatac ctaattttaa actaatataaa agaaacagaa aagtatatac
193101 atacagtaag actatacttt aatttcacat atagctgatt ttaaatctaa
193151 gatggagacc taagatggag agggagagta agcaagccaa gcaagaggaa
193201 aagaaaaag attctgagca aactgtcgca aagacaaaaa accaaacact
193251 gcatgttctc attcataggt gggaattgaa caatgagaac actgggacac
193301 aggaagggga aaatcacaca ccggggcctg ttgtggggtc gggggagcgg
193351 ggagggatag cataaggaga tatacctaat gtaaatgacg agttaatggg
193401 tacagcacac caacatggca catgtataca tatgtaacaa acctgcacgt
193451 tgtgcgcatg taccctagaa cttaaagtat aatttaaaaa aattgaaaaa
193501 aaaaagaaaa agattatggg tcagaaaatg ccaaaggcag agaaagagat
193551 agaataagga agggaaagaa agaaaaagac agctgtaact gaaaggatga
193601 gctgaagtct gggccttcg gggtccccac ttggtcttgc ttctagccac
193651 aactggactg cacgcctcct ggctctgcac tcctcctcct ctgcttcggc
193701 tgctaaaatc ttccctggtc taacttgtgc agagagctgt aggctactac
193751 ttccacagat ccccaaagcc ctgacctgat cttggtctaa tcacagtaat
193801 cactgtcatt agtttccttt ccacttattc agtgaacaaa actaaaagct
193851 attcactttg catatctcct ctatctctga gaatgaatgg agacccaagt
193901 acctacctga tacgaacaaa attcgtatta tgatagaaac aaagcaacaa
193951 agccaaacca ggacttctgt cgcctcaaca gtcaatgccc aaacttgtct
194001 atgtatccat ttctcactga aaaatcacca cctctgagtt acacaataga
194051 taataaaatg actagacata ttccaccact ttacatttctaa gcttttgttt
194101 tagttagtca gttattatt taggtaaatt aggtataatt gccttcaaaa
194151 ggagataagt atattactag cacttaacac atttcttaaa tcattggtat
```

FIG. 5 CONT'D

```
194201 aatatgttca ttaaaagaac tgtctgaatt tgaagctctg aagtaagtga
194251 gtgactttgg gcaaattact taatatcttt gaactttagg ttcttcatct
194301 ataacatggg gctaataata cagtattaaa cacaaaggta gttttaagaa
194351 ttcaacgagt tgaatgcttg aaactgtacc tggcatatag caagcattca
194401 acaaatgtta cttcttatta ttacttctat taaccgttat ctttgctacc
194451 tagctgcata aaacttaact atagtttggc tttttgcttt tgtaaaaaat
194501 agattaattg tagacatttt agaaaaaact ttaaaaaata acacatggaa
194551 agccataatg aaaagcaaaa gttgaatagt agatagatag atagatagat
194601 agatagatat taaaattgaa aagcaccact gacatccttt tacagctggc
194651 ttacctcaaa gtctatcagc tgcaggtcag ctatcagtgt cactagcagg
194701 ccactgctgt agagttcttg tgctagctga gccactgctt ctgttggggg
194751 ttctttctcg tttgtaccac acagaatttc tttcattgct tgcagtgatt
194801 tagacacttc ttctgaagcc tagtgaccaa aacgtatgct aacggttaaa
194851 agaataaaaa tgtttaggcc ataaacaaac aaacaaataa tccaaaaaac
194901 cacttcttgg tcttgggctc tgtttattta taatgaatgg cacagttaca
194951 aacaaacaaa aacagtgagg ggaatcacca tgtttgggtg gacctagttt
195001 ctaatggctt gcatttacat atcaaaggtt gccagcctgg ctctaagagc
195051 cggggctata caagaaactt tttcggctct ccctctccct ctccctctcc
195101 ctctgtctcc ctctccccac ggtctccctc tcatgcggag ccgaagctgg
195151 actgtactgc tgccatctcg gctcactgca acctccctgc ctgattctcc
195201 tgcctcagcc tgcccagtgc ctgccattgc aggcacgcgc cgccacgcct
195251 gactggtttt ggtggagacg gggtttcgct gtgttggccg ggcaggtctc
195301 cagcccctaa ccgcgagtga tcccgccaac ctcagcctcc cgaggtgccg
195351 ggattgcaga cggagtctcg ttcactcagt gctcaatggt gcccaggctg
195401 gagtgcagtg gcgtgatctc ggctcactac aacctacacc tcccagccgc
195451 ctgccttggc ctcccaaagt gccgagattg cagcctctgc ccggccgcca
195501 ccccgtctgg gatgtgagga gcccctctgc ctggctgccc agtctggaaa
195551 gtgaggagcg tctccgcccg gccgccatcc catctaggaa gtgaggagcg
195601 cctcttccca gccgccatca catctaggaa gtgaggagcg tctctgcccg
195651 gccgcccatc gtctgagatg tggggagcgc ttctgccccg ccgccccatc
195701 tgggatgtga ggagtgcctc tgcccggccg agacccgtc tgggaggtga
195751 ggagcgtctc tgcccggccg ccccgtctga gaagtgagga gaccctctgc
195801 ctggcaacca ccccgtctga gaagtgagga gcccctccgc ccggcagccg
195851 ccccgtctga gaagtgagga gcctctccgc ccggcagcca ccccatctgg
195901 gaagtgagga gcatctccga ccggcagcca ccccgtcagg gagggaggtg
195951 ggggggggtc aacccccgc ccggccagcc gccccatctg ggagggaggt
196001 ggggggtcag cccccccgac cggccagccg tgccatccgg gagggaggtg
196051 ggggggtcag cccccacct ggccagccgt gccgtccggg agggaggtgg
196101 ggggtcagc ccccgcccg gccagccgcc ccgtcgggag gtgaggggtg
196151 cctctgcccg gccacccta ctgggaagtg aggagcccct cagcccggcc
196201 agccacccg tccgggaggg agatgggggg gtcagccccc caccccggcc
196251 agccgcccg tccgggaggg aggtgggggg gtcagccctc cgcccggcca
196301 gccgccccgt ccgggaggtg aggggcgcct ctgcctggcc gcccctactg
196351 ggaagtgagg agcccctctg cccagccagc cgccccgtcc gggagggagg
196401 tgggggtgtc ggccccccgc ccggccagcc gccccgtccg ggagggaggt
196451 ggggggggtc agccccccg cccggccagc cgccccgtcc gggaggtgag
196501 gggcgcctct gcccggccgc ccctactggg aagtgaggag ccctctgcc
196551 cggccagccg ccccgtccgg gagggaggtg ggggggtca gccccccgc
196601 ccggccagcc gccccgtccg ggaggtgagg ggcgcctctg cccggccgcc
196651 cctactggga agtgaggagc cctctgccc ggccagccgc cccgtccggg
196701 agggaggtgg gggtgtcagc ccccgcccg gccagctgcc cgtccgaga
196751 gggaggtggg ggggtcagc ccccgccc ggccagccgc cgtccggg
196801 aggtgagggg cgcctctgcc cggccgcccc tactgggaag tgaggagccc
196851 ctctgcccgg ccaccacccc gtctgggagg tgtgcccaac agctcattga
196901 gaacgggcca ggatgacaat ggcggctttg tggaatagaa aggcaggaaa
196951 ggtggggaaa agattgagaa atcggatggt tgccgtgtct gtgtagaaag
197001 aagtagacat gggagacttt tcattttgtt ctgcactaag aaaaattcct
197051 ctgccttggg atcctgttga tctgtgacct tacccccaac cctgtgctct
```

```
197101 ctgaaacatg tgctgtgtcc actcagggtt aaatggatta agggcggtgc
197151 aagatgtgct ttgttaaaca gatgcttgaa ggcagcgtgc tcgttaagag
197201 tcatcaccaa tccctaatct caagtaatca gggacacaaa cactgcggaa
197251 ggccgcaggg tcctctgcct aggaaaacca gagacctttg ttcacttgtt
197301 tatctgctga ccttccctcc actattgtcc catgaccctg ccaaatcccc
197351 ctctgtgaga aacacccaag aattatcaat aaaaaaataa atttaaaaaa
197401 aaaaaaaaac aaaaaaacaa aaacagtaag cactgccttt tttattttgg
197451 aaaatattat aagtattata aaatttattt atataaaaca gctctttggt
197501 atttctactt agtcaacata cactaaataa tctttttttt ttttttttag
197551 atggagtctt gctctgttgc ccaggctgga gtgcagtggc acaatcttgg
197601 ctcactgcaa gctccgcctc ccaggttcat gtcattctcc tgcctcagcc
197651 tcccaagtag cggggactac aagcacccgc caccacgccc ggctaatttt
197701 tatactttta gtagagacag ggtttcactg cgttaaccag atggtctcga
197751 tctcctgaac ttgtgattcg cccacctcag cctcccaaag tgctgggatt
197801 acaggcgtga gccactgcat ccgcccagt aatcttttaa accacactca
197851 ttgtctaatt ttgctagcaa ttcaatataa actttatgct tgaaaattaa
197901 attgattcca ttttgaagac ttatcagtag ctactgatct ttatttaaag
197951 cattgtgtta aggttttttca acaaatccct attcctctga ttttcgaatg
198001 gtccaagtat aagattgtaa attgtcaaaa ctcataagct ttctttgtca
198051 atccatttat tcctcacaca gaatcactgt cttttttgct atctatgaaa
198101 cttaaaaaaa actcactata tttaaagaa tactagcaa atccatagag
198151 gcagaaagta catagattag taggtattag ggcctggggg agagggaaat
198201 aagtaatgac tactaatggc tccagggttt cttttgggag tgatgaaaat
198251 gttctagaat tagatagcgg tgagttgcaa aactttgtga atgtactaaa
198301 aaccaatgaa ttgtacactt taaatagtga attatatggt atgttaattt
198351 ttaatatctc aatttaaaaa tctttaaaat taatataggt aggaaaggag
198401 agcagattaa tttagttaac aatttgtctg aatatttaa agaaatatac
198451 tttcattact tttaagtata atattgtaat cattataaat gaagaaggaa
198501 atgagtagaa taaggcaaat tacataaaaa taactcatgg tagcatgatg
198551 caactttgt tatttattta tttttatttt tctctagttc tgcttcttgg
198601 gtgacgctac ttttatttat ttgtttattt taagatgga gttttgctct
198651 tgtcaccgag gctggagtgc aacagcacaa tctcagctca ctgcaacctc
198701 tgcctcctgc gttcaagcga ttctccggcc tcatcctccc tggtagctgg
198751 gattacaggc acccaccacc gtgcctggct aattttttgta tttttagtag
198801 aggcggggtt tcaccatgtt ggccaggctg atctcgaact cctgacctta
198851 ggtgatctgc ccacctcagc ctcgcgaagt gctgggatta caggcgtgag
198901 ccactgcgcc tggctgacac tacttttaaa aagtaatttt tcatatcctt
198951 aatagcctga ctgaagcaat ccttaatgta ctaaagaccg gaagcatctt
199001 aaattgtgag atatatccac agaagagtgc tttaaacata catggagagt
199051 atgtttaaga gagagttaag gataataata aaggaaacat ctttatgacc
199101 atcacccagt caagaaacag gacattttca gcacccagga gtcacctgaa
199151 ggccccttc agctcagatg taaatatttt tatatctctt gtgacaaaca
199201 tgtctttaca tttcttatta ttcctatttt atagatgaga aaacttaggc
199251 tgaaacaata tagcttagtt ccactgattt tcaactttat ggatcagtac
199301 attaccccctt catgacttgc ttctttcatt caacattatt tttaagaaat
199351 gcatctatac tgttgcatgt aggcagaagt tctttaattt ttatcacttt
199401 ctaatgttcc acactaatgc ctataccaca acttttttat tggttctact
199451 gttcaaggac attgggttgt ttccatgaaa ggatttttat taacaacaat
199501 gctatgaaca ttcttgtaca tttttcctgg tgcagatgtg caagaatacc
199551 tctagagttt ataactagga gtggcactgc aggcacatgc atatcttcgt
199601 atttcacaga taataaactg gttttcaaag cagttacatc aatgtatatg
199651 tcatcatcca cagttaatga aagtcctcat tgctctccat ccttgtcaac
199701 acttaacatc atcacacctt tcattttg ccaagacagt agttgtgtaa
199751 tctgaattta ttgtggtttt agttggcctt ttcctagtta ctaatgaaaa
199801 tgtgtaaaaa ggttttttt tcttttttct ctcttctacc atttagattt
199851 atacttgcaa aaaagccatt ttcttctat ttgggccaag atttggctca
199901 atattacaaa gtgtactaga attagaataa gctatttcta caccccttgt
199951 agaattcaat attgtatcat ttactggaat agaaggatac tatgaactcg
```

```
200001 tgtatttctt ttatagatat cttgaatctt gccataaact ttagagagaa
200051 atcgaatata taggattcaa tatcccttg aaggaataac tagcattcct
200101 atgaggaagc cccacttaat aagaccttaa aaccgtatga aaatgagatt
200151 cactgtaaca gaaactatca gtcaatcttt aaataaaaac tttttacctt
200201 tcatgtaaat gtaacattac acaccagtat aaccttttag atctttaagc
200251 tgtgtagtct agagggatcc ggtgtggtca gagtctctag agagtgaacc
200301 taaagttcat cacaacagac taaataataa tcagttgcat aaaacctgaa
200351 atcaacttaa atctatttat agagggtcta tgtgcacatc acagaccata
200401 ttttgaattc ttcattaagc ttttacattg gtttttggca ttgcgatgca
200451 tgtactttaa tcataatgtt actgttttag ctcttacctt gtctgtcttt
200501 ttgtcttgct ttccaaaat ggccaaattg tctttcagga ttttcacaat
200551 ttctgctgga tttttgtgtg atttactaaa caaaggcatt tttttcatgt
200601 gtagaaatct cttcttccaa tatggaatgc taaaaacaaa taagccaaca
200651 aaaattataa ctttaactct taatatgctt aaattttat accaatgtct
200701 tataagtttt caataacatg aattcagtaa tctgaaacat taaaagtgat
200751 caaattaaaa tgagtttcaa gttttatgcc aaatttaaat acatatattt
200801 ttaaaaagat atttttaaag ttttgcttga aagtttttat acaaagttta
200851 aaatctttcc tgcaatagaa acataaggat tatacaagaa ataattttag
200901 agtccaagtt gatatgtaaa actagatatt ttgaccaaag aaagtgataa
200951 taataataaa tatattctat aatgtttagc tatatgtatt ctataatgct
201001 tagctgctat tattacaaga agttccatga catagttaat gaactatttc
201051 acaaaagaga aaggcacagt agtttagata tgattctatc ttaaatgtcc
201101 tagacatttc tggctctttg agtcaattat accttttcc attatttaa
201151 aaaacataaa cttattctct gaatgcataa taatcaatga tcaaatattt
201201 tgcattaaag tagaattta aaaagaagcc aaatgcattc atgtatagac
201251 atacctagga gatactgtag gttcagttcc agaccattgc aataaagcaa
201301 atttcccaat aaagtgagtc ataaaatgta tttggttttt cctagtacat
201351 ataaaagtta tatttacgct atactgcagt ctattaagtg tgcaatagta
201401 ttatatctaa actgatgggt gcagcacacc aacatggcac atgtatacat
201451 atgtaactaa cttgcacatt gtgcacatgt accctaaaac ttaaagtata
201501 ataaaacaaa aacaaaagca aaaacaaaat gaaaacaata tgtataactt
201551 gatttataaa aatatttatt gcctgaccct tcagtgagtc ctaatctttt
201601 tgctggttgg agagtcttgc attaatgttg atggctgctg actgatcagg
201651 ttgttggctg ctgaaggatg gagtagctgt ggcgatttct taaaagaaga
201701 caataaagtt tgctacgttg actcttcctt tcatggaaga tttctctata
201751 gcatgtgatg cagtttgtta gcattttact cacagtagaa ctgctttcaa
201801 aattgaagtc agtcctctca aaacctgcca ctgcttatc agctaaattt
201851 atgtaatatt ctaaatcctt tgttgtcatt tcatcttcag caggagtaga
201901 ttccatctta agaaaccact ttctttgctc atccatagaa gcaacattcc
201951 tcacctgttc aagttttatc gtgagattgc agcaattcag tcacatcttc
202001 aggctctatt cttaattctt gttcccttgt tatttccacc atattggcag
202051 ttacttcctc cactgaagtc ttgaacccct caaagttacc catgagagtt
202101 agaaccaact tcttctgaac tcctgaaaat gttgatattt tgacctcctc
202151 ccatgaatca caaatgttct taatggcatc tagaatgatg aatcttttac
202201 agcaggtttt tctattaagt ttgcccagat ccattagagg aatcactatc
202251 tatggctgct tgcatcttat gaaatgtatt tcttttgttt gtttttttaa
202301 cttttattag aacaatatga acatatgaaa tgtatttctt taacaagtct
202351 ggaaagtcaa aattactcct ttatccatgg gctgcagaat ggatgttaac
202401 aggcatgaaa acaacattaa cctccttgta aacctccatc agagctcctg
202451 gatgatgagg tacattgtca atgagcagta atattttcaa aggaatattt
202501 tattctgagc agtgggtctc aacagaaggc ttaaaatatt cagtaaacca
202551 tgctgtcatc aggctttgtt gttccattta tggagcacag gccaaataga
202601 tttagcataa ttcttaagag cctagggttt ttggaatggg aaatgaatat
202651 tagctcctac ttcaagttac cagctgcatt agctcctaac tagagagtca
202701 gcttgtcctt taaagccagg cactgactcc tcctttctag ctatgaaaat
202751 cctagatggc atcttcttcc aatacgaggg tgttccatct acactgaaaa
202801 tctgttgttt tgtgtggcca ccctcaccaa tgatctcagc tagatcttct
202851 ggataacttg ctgcagcttc tataaatagc acttgctgct ttttcccctg
```

FIG. 5 CONT'D

```
202901 cactttatg ttctggagat ggcttctttc tttaaacctc atggagcaat
202951 ctctttagc ttcagactt tcttctgcat cttccttacc tctctcagcc
203001 ttcacagaac tgaagaaagc tggggacttg ctctggacta ggctaaaggg
203051 aatgtgtgtc tggtttgatc ttctatccag accactgaaa ctgtcttcgt
203101 attaacaatt agctgttttg ttttcttatt atttgtgttt tcactggagt
203151 agcacttttc attttcttca agaactttc ctttgcatcc acagcttggc
203201 taacttactg atgcaaaagg cctagcttc agcctacctc cgctctggat
203251 atgccttcct cactaagact aatcatttt ccatcttttg atttaaagtg
203301 agagatatgt gactcttcct tttccttgaa cacgtagagg ccacttatag
203351 ggttatgagc cagcctaatt tcagtattgt tgtatcttag ggaacaggga
203401 ggcctgagga aagtgagaca ggggaacggc cagtcgatgg ggcactcaga
203451 acacatgcaa catttatcga ttatgggcac agtctgtggt gtcccaaaac
203501 aattacaata gttaacatca gagatcactg atcacagatc accacaacat
203551 atgtactaac aatgaaaaag tttgaaatat tgtgagaatt aacaaaatgt
203601 atcaagagat acaaagtgag cacatgctgg tgaaaaaaat ggcaccaata
203651 gacttcctca atgcagggtt gccataaacc ttcaattttt caaaaacacg
203701 gtgtcttcaa agcacaacaa aggtgaaaca caataaaata cggtatgcct
203751 gtaattgctg tctttctccc tgtagttcta tagcactaag ggaaagatat
203801 ataactgtag gaattttaaa tactccctga catcaaaaca gagtacaaat
203851 tataacatgg tatcatagat atgatatgat ttttgtcca ttattacttt
203901 gcttggttct cactgtaaca agctaatgct aatttactta aattaaaaac
203951 gttttcaggg tttccatgtc aatctggtga taagcatttt ctgattcact
204001 atctcccctt ttcatctgat ggtgggtttg ttcatttatt cattgaataa
204051 ataatctgag taattactga gcacaggcac tttgctaaat actagggata
204101 gagccacaaa caagaaaaac acaatccctg ttctttgaag cctattatta
204151 agtggaaaaa gcaaacattt tagggcaatg gggttatata atggggaaat
204201 aacacacagt atactgcctc aatacaatct cctttaaaaa ttactttcat
204251 attttactat acctacttat tgtaataagt ataatatgat tagtttaaca
204301 atgttttaaa atttcatctt atcattattc ttctattttg ggatccatat
204351 tttgaaggaa atcaaagttc atgctcttaa actatgcttg agttccagca
204401 cccagacccc ctgcaaatta aggcagaact ctcctgcctc tcccagttct
204451 tctcagacca tggccagccc cactccattc ccagactaaa cacctccccc
204501 actcccagac taaacacctc ccccactccc agactaaaca cctcccccac
204551 tccaagacta aacacctcct ccatcacctg gaacttgag gctgcctttc
204601 tcacactctg ggcgaccatg ctggtcacta tatatacatc tactccaatc
204651 acatcattta gcccactggt ggtcatttaa gcaatgaagc aagtagcact
204701 caaaccttct acacaaacac aagacacgta aactccctct agttgattgt
204751 aactgatctg ctgtatgatt caaaagaagt taatcacccc cttctaggtg
204801 tcacttgttc tatctgtaaa acgaagttgt tcttaaagta agattgagca
204851 tcagggctct aggttattca ccactgtccc acacccattc tgagtcttta
204901 acccccagta tcctatcatg ataaagataa agccaaaaat aaagtgctta
204951 agctgggaac aaaaggaatg gagaggcctg acaatggtgc cttgtgggga
205001 taaggtggca ggaaagtaat ttttccataa agtctacctc agagttttaa
205051 gaacatacat tctgtttcag caaagcaggc agtggggaca ggaaaagacg
205101 catgttagtc cagaaggctg acactagata aatgcctcct aggcattgaa
205151 aacggtgttg agaccacgca catcaacgtg ccctcagcat taatgctgac
205201 agcaggccat gcagcacaga aatgttagtg gactgacaat ggccctgtta
205251 tactttcct cttccagcag tcagtaagca gaataaacaa caaataggtt
205301 gtttattatt attaaaggaa cacaatgaaa ggaaataaat gccctgcaga
205351 cttgggcaag aaaggttgct tctgaaatta attctctata aagctagaac
205401 agatataaat ttaagaaaag aagaaaagga gacaaaaagc tcttttagac
205451 aaaaaaaaga gctagccaag gtaaaagact gaaaatacac acatatatgc
205501 acatataaat acacacatgc ccaagatgca gactgggaat cccaaactgc
205551 atagagcaga ataacaatac agaaaatggg tctggggcaa cttcaaggta
205601 caaaattagt tagtgtgcat gtattcattc gaaaagtatt tactgagcac
205651 ttataatgta ctaggcactg aacaaggaaa tacgaaacaa agaagcctca
205701 aagggctcac gatgtagtga gagacacaga cacgtgcaaa attttcccag
205751 aaggcgagaa aaggtcgaaa aaactaaaat gatgaagaaa agatatagag
```

FIG. 5 CONT'D

```
205801 tgtgtatgga tacatatctt tatatctata taggtattttt atagcgatat
205851 gaagaaaatg gagtgttatc ccctaacaaa caggtgttac aacaatggag
205901 gggggaggat aggaagccaa aaacagcaaa ggcattaaaa ctggaacaga
205951 atcaaagata taacagcgta aacagaaaaa caatctaaac ttgatcattc
206001 gaacgatttt tctagttgag attcatgata agacccaaca ttcagtgtct
206051 tgcagctttt aaaataaaca tttccttctc agatcacatt ccaacaaaat
206101 gaccttaaaa aaacaaacga aagcataaaa atcaggttgg ttttagactt
206151 ccatgaacca aatgccccaa ggccatggag aaaacctaga gttctgataa
206201 gtaaagtcta taacaccata attaaatcct tagccaatat accatttatg
206251 tgtgaacaga tagtgtatat ttactaaaaa tggaacaaaa agatgagatg
206301 gaatgaggcc cacaaagagc tcaacaaaat taatgctaaa aaatcagaaa
206351 tagttcttga aaaggagcct gtatattgtt ggcagaacat gtgggagggt
206401 gagaatctac aattataact cattcatata ggaataaaaa taaataagga
206451 ttcaactaaa gaagttaaaa aggaaactgc cccaaaaatc tccaagaaaa
206501 gatggatgga ataatgata gaagtagaaa taactcaatc agagaagtaa
206551 aagaaaagga agaaaacctc tggtagctat ttggtccggg ttttcttctgg
206601 tgatagatgt gtctgcccta cttcccacat caccctcaccc caacaaaagc
206651 gggggaacat gacccaggtt tggccacagt attccctgtc ctggatgcag
206701 caactagcta gtaaatagat tgtgacatag ccaatcaaaa taaaaaagaa
206751 gaaagaaaag tgttgatgag aatgctgaga aaagggaact cttgtacatt
206801 gttggtggga aggtgaatta gaacagccac tataagaaac ggtgtggatg
206851 atatgccaaa aataaaaatg gaactaccac atgatccagt aatcccactt
206901 ctgggtatat atccaaagga actgaaatca gtatgtcaag gaaatatctg
206951 cacttccgta ttcattgcaa ccttatttac aatagccaag acatggaacc
207001 aacctaagtg tccatcaaaa gataaataga taaaaaatgt agtacaggct
207051 gggtgcggtg gctcagtcct gtaatcccaa cactttggga ggccaagatg
207101 ggtggatcac ttgagtccag gagttcgaga ccagcatggc caacatgggg
207151 aaaccccgtc tccacaaaaa atacaaaaat tagctgggtg tggtggcagg
207201 cacctatact cccagctact caagaggctg aggcatgaga atcgcttgaa
207251 cccaggggggc agaggtttca gtgagccaag atgtgccact gcactccagc
207301 ctgggtgaca aaacaagact ctgtctcaaa aaacaaaaca ctgctttaaa
207351 atagattcaa agcagagaca aaagagaaaa tggctatatc ttcattcgat
207401 atagccaaat tgctttctca agttttttatt ccagtttata ctttcacagc
207451 tgtgtagtgt gagttgcagt tatcacccat ccttcctaac atttggacct
207501 gtcagaattt aaaaatttcg ccagtatgac agctgtaaaa ggttgtccca
207551 ttatggttgg agtgcagttg tgtaataacc gcttgctgca gtcttgacct
207601 gttgggttca agcaatcttc ccacctcagc ctcccaagta gctgggacca
207651 caggcatgtg ccaccatgtc cggttaattt ttgtattttt agtagagacg
207701 gggtttgcca tgttacccag gctggcctcg aactcctggc taattttaat
207751 tttatgtaga gacatggtct ctgtatgttg cccaggctgg tctcaaactc
207801 ctgagtttaa atgatcctct caccttggcc tcccaaagtg ttgggggttac
207851 aggtgtgagc caccacacct gacccatact agctttttaa ctttcttatt
207901 ctgtacattt cctaattcta tactttgccc atttcatatt taaaaaaaat
207951 tttagagaca agttcttgct ctgtcaccta ggctggagtg cagtggcagt
208001 cacagcttac tgcagcctcg aactcctgac cttaagtgat cctcccacct
208051 cagccttaca aagtcctggg ataataggcg tgagccactg tgcccagcta
208101 ctttgcccag ttctttaagg tggctgaaga aagtcatatc agctgccaat
208151 accaactagt acagtccctc gctaataaat ataaatcacg tgcaagaatc
208201 atgaggtgtt tgatgaaaat caagaatata aaagagaaat gtaaaaataa
208251 atagagcaaa ccctgggggg gatggtaaaa attatattat atttatataa
208301 ccaaaagata tactatgcta tcacatccat aaaataagaa caggctgcta
208351 tgaaaaagaa gtaaacaatg aatgagaaaa cattcttgga actaagaaca
208401 tgcaatgcaa tagaatagct gattggtaga agggtataga attgaaaaac
208451 aaatccacaa tttaaagacc aagccatgga aatctggaat gaagagtaaa
208501 atacaaagaa aagcaaagaa ctaattcaca gaaaagttgg aaatatacag
208551 ggtagagctg gagagccaat attgattgaa tataaatgct taaggaaaaa
208601 gaaaaaaaca gataactgat gagagagtaa caaatacatc aacaaataaa
208651 aaggaagcaa aattcctaga gctgaacatg tcttcagatt taagtaaact
```

```
208701 aatggttatt acacagaggg aatgcaaaaa ggcctattcc aagatacact
208751 gtgaaatttc tgaactctaa agcgaaatcc cacaaacttc cataaagggg
208801 aaaaatctag agtggcacct aagaaccaga ctgtcagagt ggaatcagga
208851 ttagtaactt cacaccaaat gacagaaggc agtgaaacac tgtttacata
208901 gtttctaggg aaaaagattt ttcacctaga attctatact ttaccaatta
208951 tgcagatgtg agggcaaact aaaattacct aaggacaaag atggtgaagg
209001 agtaggggga agagaaagga agatggagga gaaacagaaa aatgagaaaa
209051 cagttgaaaa gtaagcagtt gagcaaagaa accaataaaa tacatggcta
209101 aatctaagta aaggttgata atgtgtctgt gatgcttaat atgactgcta
209151 aaaatgtatt cctgaagtat tttgatagag gcaaaatgtt ttttaaaaaa
209201 tccaaccatc tggaaaaata caactaaaat tcttttatag actttgttca
209251 aggaaaagga tagaaataat gattaaatca taataaaatt tatatgggtt
209301 tgtcatgcca aactaattta agtctctggg ttttctataa tcacatcata
209351 cacaaattaa gataaacctg tttcttgaat tgtttattaa acatttaatg
209401 atgaatatta gaataatgga agtaggatgc aaccaccaga aggggggaaaa
209451 caggaacaaa aataatttga ccaaatcagc aaaaatcagg aatgaaaagg
209501 aaagtataaa caaatagtaa acagagaata taaaacaata tagaaggaat
209551 aagagcaacc aataattaca atacatacaa atgtgttaaa ttctactact
209601 aaaaaaccaa gactctcaaa ctctcaaatt gggttcacac acacacacac
209651 acacacacat ttctgctcta aattctgcaa gagccataat agaaacaaaa
209701 cgacacaaaa atgttcagaa taaaaggatg cataaatata tatcaagcaa
209751 tattacaaca tgaatataag aaatgcagag ttcatgagaa attatacaca
209801 cacacacaca aagcatttaa tatatgtatt tagttgtcat gaagagaata
209851 tatagaggtt attatactac atatacagtg tatgtaatag acataatcat
209901 acatataaag ccaattaccc ttgcaaattt aatactattt catatgtata
209951 ttaggtacaa taaaggctat attaaatagt tttaatttgg tgaccttaat
210001 atgctctagg tagaacaagg aagtcattgc ttgaaaggaa acagaggaac
210051 aggcggtggt tcacgcctgt aatcccagca ctctgggagg ccgaggtggg
210101 cagatcacaa ggtcaggagt ttgagaccag cctggccaac atggtgaaac
210151 cccatctcta ctaaaaatac aaaaaaaaat tagctgggca tggtggtgca
210201 tgccagcaat cccagctact caggaggctg aggcaggaga atcactggaa
210251 tccgggaggc agaggttgca gtgagccgag attgtaccac tgtacttcca
210301 gcctgggcga cagagcaaga ctctgtctca aaaaaacaa aaacaaaaca
210351 aaacaaaaaa cagaggagtc tggtagggaa agagataaaa gatagctact
210401 gacagaaatg agaacaggag ctactgggaa agtgatctac attattttca
210451 gtttaaatat gttcaataca gaccctaagt aaaattctgg ccaataaaaa
210501 tcaaagctg tgtttacaaa acaaaatacc aaatcaggtt tttaataata
210551 gaaaattgat gaatataata aattatatca ataagtcaaa taaaaattat
210601 ctcagtggca tctgaaaaag ttatctaata aaattaaaac caagagagat
210651 acaaatctta gctcaattta caaaaaaatg gttaatggag gcatacttac
210701 taaaaggagg tataaaacaa aggtcatcac aatcacgcta tcattaccat
210751 atgttgtgat caatgcacta aaatataaaa cataaataaa tgctacaaaa
210801 tttgggaagg atgtgacaaa attgtaatta acagacaata tgattatata
210851 cctaaaaata tgaacaactg aaattagtag aaattaggtt aagtagtcaa
210901 atacatgata aatatacata cagcttttcac atataagaaa ttgccagtca
210951 gaaaacataa tgaaaagcat atttttgatca tactgccaac taaatatgta
211001 caaaatctat accagatctg tatttttaaaa aactacaaaa ccttaatttc
211051 gaaaatagga taattactct tcctgaaata gaaaactaac aaataaaaca
211101 gagaaataga agatgtactt atagatgtat gtgtctattt atctattcat
211151 cccttcagct agccatcctt ttaatcttat agtcacagaa tgattctaga
211201 atgtggctta gctaatctta atgacattat ctaaattatg agatttgtga
211251 tggtttaact ttcttcatgt aggtattttt ctgcattatt tataatgagc
211301 acatttcttt tttctgaaat aataaagaga ctgtggagaa aacctacata
211351 attaagatag gaaagatttg aggttaaaaa aaacactcta ttttgttctt
211401 gaatagacag aataaatatt atttaaatgt cagttattct taaagtccac
211451 agtttgatac agttccaatc aaatgtccaa aaaaattttt ttggtatcta
211501 aatttagtca agaatactaa ataagcaaga ataacaaatt ttaaaaagga
211551 aaattaggag gaaatgaaat gaaaagtgtt ataaagtact gtaacacagt
```

FIG. 5 CONT'D

```
211601 aatagcacaa gaaacaaaca catcaatgaa caacacagct cagatataga
211651 tgttaatata agtgactttc aaatttctgg atgtgaaata gtttctgtaa
211701 ttttataagt gataaaataa atttcaaaga aaaagaccaa caaatcaaag
211751 ttaatacgaa tatgccacaa acacaaaaat ttgaatttct atagataaat
211801 aataaaaaaa attataggca aacaacaaac tagagaattc tgtgatatga
211851 atctgaaaga tggagggcta atatcattac aaaagatctc tttaagacaa
211901 ttaagaaaat cattaaggaa acatacagat aagtgaaaac cataaatgag
211951 gaattacagt taatgaacat attagtaaat gtttaaccat tctctataat
212001 aaaaaaaaat gcaaactcaa agtgaaagac tattttgtcc attatgttac
212051 taagtttttt gttgttttga caaactcaat tctattgatg gtattttgca
212101 acaggctctc atttcttact ggtgcagata taaattagac aataatttga
212151 caaatatgaa tctagaacct taaaatgttc acaacctctg gctttatagt
212201 aattccattt ctggtaatct gtcctaggaa aataaactaa aataaaggat
212251 tatctttaca tgcaaaaatg tttactgcaa tttttatca taaaaaactg
212301 agaaatatct aatctaacag agggaaataa ttaaattgtg atatacccag
212351 ttgatggaac attagcatat gtcacagatt ttttaaactt ttaaactttt
212401 tacaattatt ttacatttta acattttcaa agcttaggtg tgtcttacaa
212451 ttgttggtgc cttacactaa caggcagatt cttttctttc tcggttgtac
212501 ataaagtaac catatgtctt aaaaccagcg acttattaaa tttgatgaaa
212551 tatgtctagg aaaatatttc caagaatgt gaaatagaat ggaaatgtta
212601 atgttaaaaa caacatccca aattacagag cataactaca actatgtaaa
212651 gcaaacaaaa acacaaacac acaaaaccta tgtatagaaa aaataatttt
212701 gaaatgttaa cggtgattgc ctctgagtaa tgtagtttgc ttgtggatgc
212751 ttaatttcct tctttcttca aatgttctgt tttttccgaa gcttgtataa
212801 tagatcatgc aaatgctttt atagtagaaa tgtctctctt aaatggtatt
212851 ttgaatgaat aaacaaataa ccttttttt taagttcaa actgtggaat
212901 atctgattgt catgtctttt ctttctttt tttttttttc tgagacggag
212951 tctcactcta ttgcctaggc tggagtgcaa tggcatgatc tcggctcact
213001 gcaacctccg ccccccgggt tcaagcgatt ctcctgcctc agcctcccga
213051 gtagctggga ttacaggcac tcaccaccac gttcggctat ttttgtattt
213101 tagtagagac agggttttac catgttggcc aggctggtct ggaactcctg
213151 accttgtgat ctgcctgcct cagcctctca aagtgctggg attacaggca
213201 tgagccacca cgcctggcct gtcatgtctt ttcaaagcat tattcaaaca
213251 tgatttcttt ggctataaag tttcataaag agtagtactt ggctcagatt
213301 ctggagagaa agccaaaaaa gatcatccaa ctctgctccc agggaactca
213351 caccctgtag attttgtagt agattttggc agcattctct ttcctaatac
213401 acagtaaaat atttcatatt cctaacttgt gtgtgagcac cattgaagat
213451 ggcccaaaat caaccaccca attgagtcat ctgaatatgt tcagtgacat
213501 aaatggaaag gagagttggc aggggcagg ggggtaggag aggacctagg
213551 ggaagagggg aatagccact tggagcatta aatgcccttg ttgttatccc
213601 acttaaaata tttcaaaggg aaaaatgtct aatatctaat ctctaactat
213651 gctattcaat aataatttga ggccaggtgc ggtagctcac acctgtaatc
213701 ctaacacttt gggaggtcaa ggctgcagtg agccatgttt gtgccactgc
213751 actccagcct gggcaacaca gtgagactct gtctcaaaaa aaaaaactta
213801 aaaaaataac attttgaatg tcaaagttt cccaggaaaa ctgaagggag
213851 tgggaaattt atatctgaag ccaaaagaga tgtctcaaca tttccagagg
213901 tataaccaaa ctgctaactc attttaagaa agacaactaa aaaatgaacc
213951 ttcttttcct cacataagtt tattttacaa tcaacaatga gttagacagg
214001 aacatttcca aaatgatttc ttaagagctt gttaatttaa cttaaggcac
214051 aggcaccttc tgttaaacta aaaaaattaa aataaaccta ccaccacata
214101 aaaaaaaatt tcagggccag gcgcggtggc tcacacctgg aatcccagca
214151 ctttgcgggg ctaaggtggg tggatcacat gaggtcagga gattgagacc
214201 agcctagcca acatggtgaa acctcgtctc tactaaaata caaaaattag
214251 ccgggtgtgg tggcaggcgc ctgtaatccc agctactcag gagggtgagg
214301 caggagaatc acttgaaccc agaaggcgga ggttgcagtg agccaagatc
214351 gcaccactgc actccagcct gggtgatata gcgagattcc atctcaaaaa
214401 aacaaaaaaa aaattcagaa aaggtcaggg atgctattcc tttacctgta
214451 ttccaaatag gattcacaga tagaaagaaa tgaaatcaag tgtacatggc
```

FIG. 5 CONT'D

```
214501 aaaaaattgt gcctgtaaga ttcattttt aaaattaaat gggatggagg
214551 ttacatgagt acatacatat gtcaatacta attgaaccat tctcctaaaa
214601 tgggtgcatt tgattatatg aaaatcttaa aacaaaaaag tgcaccttaa
214651 agttctactg tatttgctac tgtatccaag aagactctcc cccaaaaaac
214701 ataatttaga attgccttca cagagatggt taagttacaa agcatatcat
214751 tatatatgta ataataccat atcattatga accatattat atatgtcaaa
214801 gaatcttcca atcagtatct tctatgcttc aattttcca ttttaaaata
214851 tgcatcctaa atgtaattac aaagcaccac aactgaattt tgtacttgaa
214901 aacctataga tatgagtgaa acaataaagt ataaataaca actttcactg
214951 acaatcccctt tttcagttaa aaatgactaa gaataacttg tttttataag
215001 ttttattaac caaatttgag ggagaggcac tttctaaaaa tgggcaattt
215051 acacagaaat ggaaaagttg tgaggagctt tttatgagtc ccattcatct
215101 ggaagcctca gtcagactta catcagaaga aaaactcttt tataagagaa
215151 actcatgtcc cttgttaatt actctttatt tctaatgtac agtaacactg
215201 aaatacattt ttaaaaataa ttaacatata aagttaggaa tatatacaac
215251 tactactaca tttattatct aaggatccta ctaggctatt gtagttccag
215301 aaaaaaaaac tagtaacttt attcattacg ttcacactga tgtttctgtt
215351 gacagctcca gtcatttgtc agagctaaaa ttttccacct ttattagcta
215401 ttaataattg tcaatgattg aaaattttat attagaattt tacaatctca
215451 acttatagca gcgatctgaa ccaaagtcag tattctcaaa aactggtaac
215501 tatcattaaa gcattagatc ttactgaaat taacaaatgg ttactcttta
215551 aaaaacagaa ttatcaaggg agactcataa ttcagttttc attcttttctt
215601 gtaagcacat acatattaca cataacaaat tttggttagt tactgttatt
215651 gatattaaga catggtttat acaaatagtg tgaaatacaa ctatttcata
215701 gcttcagtaa gccctgtgcc tgtctatgac ctgtcaatct ataaaaacat
215751 taacatgaga gaatagagat gaaagtgatt ttgctaaagt tatctgttat
215801 ccccaagctg ttcaaagttg attcggtttt tctggctgag taatttgata
215851 taatctttca tccttccaaa gttggaaggg actatatgag tttctgctag
215901 aagtttgaga catttaagtc acaaaactgc aaagtatgtt atctcactta
215951 taagcagtaa agatctctgt ttaaactaat taattagtga ataccaact
216001 ttgactataa ttaatagaca tgctaatata gttttaatag atttttctttt
216051 gttatgtgac tatcagctaa atataatctt taagccacat tacgaatata
216101 tatgtgcatg taaacacagt catatatata tcccagaaat ggaaaattgt
216151 ccaaatctac ctgtatccat tcagtaaata cttgttaaga acctattata
216201 taccatttag gaccactcaa aatcattact ttttacataa gatttacaat
216251 agactaaaga aagtatttct tgatcaaatg caagagtttt tacgccatta
216301 caaatcatcc aagataacca aaacctgcat ctactgtatt gtttattca
216351 ttattattc attacatatg catattgcat tactgacttt taaatttcat
216401 atactggcaa tcacagaga cttcaggac cagtaaagtt aacttggata
216451 gacccaagac aagttttcca aataagtcac atttcttcat atgggtccta
216501 gtaaacattt gcaaatacat aatccttctg agttaaagtt gacacctgac
216551 tttagaatgt cccatgtact caagatacct aaccttgtaa attgcctccc
216601 ctcagcacca ttcctactca ttcaaggcag caaccaagtt ataccatggt
216651 cttttcttgt tctcttcaga gttagaccta ttctatctta cttttgcttt
216701 gttcacatct cacaattcag tcaattctttt tcaggccatc tcttttctcat
216751 aaggaaaaac gtgtgcccct aagcctcttt cctttattgg atatcttgga
216801 aaataaccca tttcaattt tgtgaaccaa agaaacagtt tagtcctcat
216851 gcaataacta ttatcaggta cctactatgt gccacacact gggctagacc
216901 cttaggaatg gctaagtaca aactcaatgg ccagaaatat tcttgtagca
216951 agaaaaagag aaatcactga tttcaatgtc agattagatc tcaaaaacag
217001 tgcaatcaac cttgaaagct catgaaagca cccagaaaac ccataagcat
217051 ccttccaaat acctatccac ctattaaact tgcttttctt taagcattca
217101 tatttagaat aaaaataata tcttatccaa cataattatt ttatatttag
217151 tttcgtcatt ggaattgact ttcttatatt tttcaaggta gcaatggttt
217201 ttctacagca tgggtaaaat acatgcttag actataataa acgcccaaca
217251 gtcacttgat aaactgtttc ccagggaaaa tgggttctaa atttccaaca
217301 acccattcac aagtaaactt ctcaaataca aagtgtttgt aaattgggaa
217351 tgcattattc tttatttcta tatttacatt cctatgggcc tgggaaatgg
```

FIG. 5 CONT'D

```
217401 taccatcact aaggtaacac agtgaatgat tagtttaaaa taaaaaatta
217451 ttctgaagag tgtgaagctg tatgcaaata attttccacc agtctaagaa
217501 ggactgagca tgggaaaatc tataaagaag taaaagtaag tttgtgatat
217551 tatctctatg atgtttactt ttaagtgcaa gatactaact agcccagaaa
217601 aggttcccac agaccagttg agctgcttct tatacatagg tcaacagtct
217651 aaaaaaaaaa ttaaaacctg caaaatccca caaaacaaaa cctgttttac
217701 aggcttctgt acacgtagag gaaatgttag agaaattaca gccattttat
217751 ggtctatcta gggtacaagc ccttctaatg tgtttactga tactctgcag
217801 aagttttcat ttcagttgtt ttgccttaaa ggattcactt gaatcaataa
217851 ctaaagacat atatatttt tgaggctagc agagggtaga ttagaaactc
217901 tgcttagagt ggtgtatcct catgcagtga ctcaatttca cagttaacaa
217951 catacacttt cttcctccta cagaacaatg attacatgcc tccctccatg
218001 cctttaaaaa gatatatata attggcatac actctcctat tttaagatta
218051 tacaaaaaaa gttttattgg aatgtgaata gatattttta agagtttatt
218101 tttctttgct ctattgctta tacaaacaca aacacacaca cacacacaca
218151 cacacacaca cacacatggt tatattagct cttcaacaga ataagattat
218201 acgagaggaa agcttggtat aaactgtaag aacaaaataa ctgctttatt
218251 ccttacttag aaacccaaat gcattcattc attttacata aagtaggaaa
218301 aatcaggtgt cacttattgg gtctaaaaga agcagtcaac atttaaatta
218351 tatatccttt gaagtaacag tatcaacatt tttatttaaa ttatgagaga
218401 atgctgtaat ttataataca aaacagtgat aattcaaaat ttactaacaa
218451 tagacagaaa gagataactt tctaattttc atgcagttga aagagaaaca
218501 tgaaaaaagg tatactgtac tgccactatt ttattttgg aaactctttg
218551 taaataaaaa cccatttcca aaataagata ttccatgaac acagaatagt
218601 tggtaatggt tcaagtgcct taggcaacag agaagtattg ttttgtagtt
218651 tttttaaacc tctcctagta acagcaattc attatgcaca aagaaacaag
218701 gtaacagcat ggtttataat gcatatataa gtaataactg cagaaccctca
218751 attaaaacta aagtttacca tattccttcc atttctataa accagtatag
218801 ataaccttgt tgatactcac caaatgttac agaaatgcct aggcttttct
218851 aagcaacaaa atgtagacac atggtgaggt gctgaagaca gctctttctt
218901 gagctcaaag cactttagat gaagtagcct ttatcgtcca tttaatagag
218951 gttgcctcct attaccaagc gtggcagaga aaagagtttc cacaattagg
219001 tcttgacttt ctgtccctct ttttgaagag taacagttac cactggaaaa
219051 cgttaccaga aaatgatcac ttgaacactc acatagggca gctgtaaatt
219101 tccactctct ttgcttgctc tcagattcca agccttgctt gtctcttaat
219151 ctgtcacagg cagttctgtt tctggtcaaa ccagcttgct tatgcgttct
219201 ccactccctc tctaacactt gctttcagat acgtaccaca gtcacagctc
219251 ccttttactt cctccctcct cagtcctgta acgtcacaag aatgcgtgta
219301 aagctgaggc aaaataaatt cttgggccaa aaaagaaaaa agtctagaga
219351 taaacaaaat ttttctcat cacttttttc tgtcttaagt cttatacttg
219401 ttcatgcatg gggttttgtc aactgattaa actggctgga ccaccttgtt
219451 taaaaatgta aataaaggtt attttaaaa aagtcatgtt gatagtaata
219501 ataacagatt cacctgctaa tatgctagct cctgaaggaa gatgctattc
219551 ccaaccataa gaaagtggag caagtaaaca cacaagtact tgtattagaa
219601 acttaatctt aacatttaaa aagcaaggaa ggttttagag tacttataat
219651 ttaaactgtg caattttatg aaaaaaatgt atttcttaat acggtatatt
219701 ttgaaacttg gaccaaaatt tgcagttata aaagggaaaa ttataaagaa
219751 catagaaaaa tattgacacc aaaaacaaaa gagcagttta atcatgtatg
219801 tgcaaaccaa atgtaattat tgctgttgga aagaaggttt ttttccccc
219851 taaacattac cggtcagaat gcataacacc tcttataaga attacaaagt
219901 ctaaaggcta caaaaaatta ttaaagtgat tatacacata caattataga
219951 gtaaagtatc ttaaaattac gaaactctct gtaaggtttg gggatgagga
220001 attaggtaga aagctgagtg ggctcgtggt tggcaggttt agatggcatt
220051 tgtaggattc tttgaattaa ggaggcaatg tatgcagctt ggaatacgtg
220101 ctggctctgt atgaatgcta gtcagatcct gctttggagt tctgttccag
220151 ttccttagcc cagaacactt ttaggttctc catctcccac tatgtcccca
220201 gtcaaaagtc ttgggccctt ctactgacgg atcttccaag tacagaagga
220251 acagaagtag ttattagacc tattattaag taacacattc ttattctctg
```

FIG. 5 CONT'D

```
220301 cagaattaaa atctctctaa gaatataagc ttaagtaagg tgaaaggtaa
220351 acatctataa acagttgttt atatccctta agaaaaataa gtcagtaaaa
220401 gtcggcctta aaatataggt gttttgatct cgtttattta aagtagaatt
220451 aaaatttaac tatattatac agttatttgg ttatttctta gcacctatta
220501 aataggtatc aaagacgact agagattagt ctgccaattt ttctttcaat
220551 tagtagtttt ataattttta gagttttatt tctccttttt aaagagatgt
220601 taaatggaaa taattctaaa tcactgaggg tatgaagtgt ctagtacctt
220651 aggttatact ccgagagttg tagtataatt aaagaaattc agaatttata
220701 aaagtggttc ttaggataac tgcaaggtta atttaaaact gggagactgt
220751 atatcaatct atagtggatt caaaggcaca aagtcaagtc aaggacttta
220801 aaacatataa ttactaagat tatttatgat tgtttgtata tttaattcct
220851 attaaatacc attccatttt ccaacagcaa gagtgcagaa atctcataat
220901 atacaggaaa ctgggttgag tattcagaag gatattgcct cagtagcgga
220951 accaaattag ttttagatta aaggttgttc tggtccctct taatagagat
221001 taaagtaag ccccgaaagg atcgaattac ttccaaataa ctgcaaccca
221051 gagtaaaatt ttaaaatatt tatataaatt ttttaaaatc tagcacacaa
221101 taacgtaaaa ttcacaatat ctgacatcca gtcaaaaatc accaggcatg
221151 caaagaagca ggaaaacata atgcataagg agaaaatcga tcattagaaa
221201 aagactcaga aatgacacaa ataatagaat tagtatacaa agacattaaa
221251 actattaaaa atatcttcca taggttcaag aaggtattag aaagataaga
221301 atgttaagga gagacatggc agatataaaa aagatctaca tcagatttct
221351 aagaattaaa attacaattt ctgagaaaac atttattctg tttcatggaa
221401 tgaagtgttg cctaactcta gaatcacaaa taaggccaac taagatcttt
221451 aaacaacagc aacaacaaca aaaaaaccct ataaactctg gaatgaaaat
221501 tacaccaaat gagatgaata gcagactgca caccgcagaa gaaatgatta
221551 gtaaacctgg agacacagtg acagaactta tcaaaataaa gcattgagag
221601 aaaaaagtt taaaaaaata aaaatgaaca gagaatccct gaactatggg
221651 gaaacttaaa agaacctaat gtatactata tactatat ttagtctttg
221701 gaccttgaat aaacatcagc agtagccaag aaatagttgt tacaggcctt
221751 gggcataacc cagtactgtg ctggcttcac gtgtgaccca gcattgacgc
221801 agtatagtcc tagcagtggt ggtcacaaga gggcttgcac catccctccc
221851 cgaactgtag gcagctcagc aaggagagac agagaaagac tcagtaaggg
221901 aagagaacac gagactgtct ggtaatccag ggaattctcc tggatcttac
221951 ccaagaccac caaggcagta tctcctcaag tctgcaagtc acaacattac
222001 tgggctttga atatcgccta atgcaaattt ggctgcagtg accaaagact
222051 tagatcacaa cactcaattc cctttgaata tctggaaagc cttctcaaaa
222101 aggacagata cattcatcct tgagaggtct ggaaaaaaaa aaaaaagaca
222151 agtacaaata agctcggagt gtgaagatta gaataaatac ctaactcttc
222201 aatgcccaga caatgacaaa catccagaag catcaagacc atccaggaaa
222251 ttatgacctc accaaaccaa ctaaataagg aaccagtgac caattctgga
222301 atgacagaga tatgcgacct ttaagagaat tcaaaatagc tgttttgagg
222351 aagctcaaag aaatccagga taatacatag aaggaattca gaatcttatc
222401 agataatata acaaagagac tgaaataatt aagaatcaag cagaaattct
222451 ggagctgaaa aatttaattg acaaactgaa aaatgcatca gagtttctca
222501 aaagcagaat tgatcaagca gcagaaagaa ttagtgagct tgaagacaga
222551 ctatctgaaa tacacagagc agtcaaaaga aaaaagaata aaataatgt
222601 agcatgccta caggatctag aaaatagcct caaaatggca aatctaagag
222651 tcattggcct taaaaggag gtagagagag agatcggggt agagagttta
222701 ttcaaagaga tagcagagaa cttcccaaat gtagagaaag atatcaatat
222751 tcaagtatga gaaggttata gaacactaag cagattttac ccccaaaaaa
222801 ctacctcagg acatctaata ctcaaacaat gaaggtcaa ggataaagaa
222851 agatcctaaa agcagcaaga gaaagaaaa gaataacata taaggagcc
222901 ccaacacatc tggcaacaga tttctcagtg gaaacatcac aggccaggaa
222951 agagcagtaa gacatatttg aaggtctgaa agaaaaaaac cttttatcct
223001 gaaatattat atccagtgaa aatatccttc aaacatgaag gagaaataaa
223051 gacattccca gacaaacaaa agctgaggga tttcatcaac ccagacctgt
223101 cctacaagaa atgctaaagg gagttcttca gtctgaaaga aaggacatt
223151 aaggtacaat aagaatcatc tggtcatctg ggccaggcac ggtagctcac
```

FIG. 5 CONT'D

```
223201 atctgtaatc ccagcacttt gggaggctga gacaggagga ttgcttgagc
223251 agagaagttc aagaccagcc tgaataacat agcaagacct catctctaca
223301 aaaaatcaaa attagccaga attgctggca catgattgaa ccactgcact
223351 ccagcctggg tgacagagca agaccctgct gaaagaaaga aagaaagaaa
223401 gagagagagg aaggaaggaa ggaaggaagg aaggaaggga gggagggacg
223451 gagggacaga gggagggagg gagggaggag ggagggacat atactcaatg
223501 gaataatatt cagctataaa aaagaatgag atcctgtcat ttgaaacaac
223551 atggatagaa ctggaggaca ttatgttaag tgaaataagc caggcacaga
223601 aagacaaact tcacatgttc tcattcattt gtgggagtta aaaatttaaa
223651 caattgaact cacagagata gagaggagaa tgatggtggc aggaagcagg
223701 gcaaagggga tagttaatcc actaatggga tgagtataaa aatatagttt
223751 aatacaatga ataagatcta gtatttgata gcacaacagg atgactacag
223801 ttagcaataa tttgttgtac attttagaat aactgaggga atacaattgg
223851 aatgctcttt tttttttttt tttgagatgg agtcttgctc tgtcacccag
223901 gctggagtgc agtggcgtga tcttggctca ctgcaagctc cgcctcccag
223951 gttcacgcca ttctcctgcc tcagcttccc aagtagctga gattacaggc
224001 atccgccacc atgcccagct attttttttt ttttttttt tgtattttta
224051 gtagagacag ggtttcacca tgttagccag gatggtctcg atctcctgac
224101 ctcttgatcc gcctacctcg gcctcccaaa gcactgggat tacaggtgtg
224151 agccactgca cccagcctgg aatgttctta acacaaaaaa ttgacgaata
224201 gttgagatga ttggataccc tatttaccct gaggtgatta ttacacattg
224251 catgcctata tcaaaatatc tcatgtatcc tataaatata tacacctact
224301 atgtacccta aaattaaaa ttttgaaaat taaaaagaca acaccttaat
224351 tgaaaaaaaa gtcactccaa aaaatagtt tgttttgatg cttttaattc
224401 taatctatca ttacagaatt ttaactctac tgctttgctc ttatattcac
224451 cttcacttat accacaaatc tttgttctaa taacacagta acataatgat
224501 atatttgcct actctttcaa tatgtctaat atagattcaa aataacagta
224551 ccaaaattac taaaaataaa atcactgaat gaagtttaaa gaattctttg
224601 ccgttaacta atgaagtggt cagcatataa ctgtcagtag tgagtcctaa
224651 tgttaaaatt taattatttt acgtgttata aaaacaaaac tattttacat
224701 tgttattcac aattgaaaga aatttcataa aacaagattt caatttcttt
224751 aagtagagac tttaacaacc tataaatggt gtagttcaat ggagttgtct
224801 caactattaa gaaaatcaca ggaagaaaaa attaaatgat gtatatagat
224851 caagttacag tcaaatggca tcatggcatg ctaaatatgc aatgattcta
224901 cagttatttg aatacaaaaa aatggtagga aaattattta tcacttaaat
224951 gtggtagctt tggtagctta actatgcaga attccaagtt acctcctcca
225001 cctcagcagt catatttaca ttattgagtg ttgtaaggct ttgaatccat
225051 cttggcatac tcgtactata acaattcact agcaataagt cctataacta
225101 gccaatgaat gtttaaggta cattattgaa ttgattagtc cattaaatta
225151 aaacattagt ggttaaaaaa gagttcattg tcaacaataa aaacaatggc
225201 acaaacctg gtttgtcatg atccccccc aaaaaaatca agactctaac
225251 atgtaaaata ctcaatacac aaatacataa ttatatgatt aagtgccacc
225301 tccacaattt agtgctatat tttgaattaa ataatattaa ttttacttta
225351 ttggttttac agttatttat attaattaa catatttgtt tttatttaaa
225401 tatataacag ttgtaagaaa aagtgtatta aggccaaggc ccagtggctc
225451 atgtctgtat tcccagccct tatgggaggc tgaggcaggt ggattgcttg
225501 agcccaggag ttcaagacca gcctgagcaa catagcaaga ccccgtctca
225551 aaaaaaaaa aaaaaataga agaaacaaaa atttagtatg ccagaagcaa
225601 atgctatgtg aatgataata gtataaaaaa actagaaatc caggttgcgg
225651 tcagattatg gagagacgga gtgctagaca aaagagctaa ataatttgcg
225701 gacaaaacag gccatgatca gaactttctg taatgaatgt gaatttggca
225751 gaagaatcaa agggcaaaga aacagtaggt gatgaaatta aggtaactc
225801 agtagtctag gatgacagtg agggtaacca gacagtggga ataaaaggac
225851 tacaagagta taatagagaa taggtttggc aactgaaaaa atatggatag
225901 taattgagag acgagtcaag atcacaaggc attcccatgc ctgtgtgaca
225951 gtaagcaggt tataccttta aaacatatag gaaccacagg aagaaaaata
226001 aattttatga aatagccagt tagttgatat ataacaagtc cgagatgcca
226051 gcaaggcttc tggatataaa tgcccacagg cagctgaaca tacagaacta
```

```
226101 gaacttggag agaaaacaga ctggagcaat atatctgggg gtcatccatc
226151 ctgccactgc agtacgagag agaccaaaaa gagagccaag gacaaaactt
226201 caagaaacat ctacaggtgt tggtagaaaa agggcaactg gctgggcgta
226251 gtggctcacc cctgtaatct cagcactctg ggaggcagat cacttaagcc
226301 cagaagttca agaccagcct ggacaacatg gcaagacccc catctctacc
226351 aaaaaaatac atacaaaaat tagttgggtg tggtggtaca ctcttgtggt
226401 cccagctact cgaggggttg agctgggagg gtcatttgag ccctggaggc
226451 agaggttgca gtgagctgag attgcaccac cgcactccag cctgggcaac
226501 agagtgagac cctgtcccct cccccccaaa aaaaggcaac taaataaaca
226551 gtggttagag agggagagga gaaactgaaa agtatgttat cgtgtgacca
226601 aaaaaaccca gaccttcaag aaaaagaagc atttaaaagt acttactacc
226651 taaccctgta gtctaatttc taagtcccac tttcaattct tacaaagcaa
226701 aggtattagt gggaaagggg cctttagaga accacttggc ccagagaaag
226751 ggacttttaa gaattcatat tccctaaatt gctaaagaca taggctggta
226801 gtcagcgaga caaaagacag gcagggacca tcagagcata cagcagtaca
226851 gcaaagcatg aggcaggcag aggactccag gccagcccct ccgggaaact
226901 ggtaacactg gctctgattc aggcagcatg cataacccaa ctctgccatg
226951 ccatgcctag aacactgtat gggagattgg agacttagta gtacctgaca
227001 caacaatagg attaggatta taagaggtta ggaatgaggt aatagagaaa
227051 tgaacgtata ttactgtttc caagtgttgg atataaagac tagaaggaca
227101 gcttgaaggg cttaataaaa gaggtttttg tttgctttaa aaaaaaaaaa
227151 aaaacctttc aactcttggt agattgagtg ggacagacag gaggaaggta
227201 gaagatgaga aagggataat taatggggca tgatctttga gcccacaatg
227251 ggagggatca agaacataag tggaataata tatattttc taaaatgaga
227301 aggaggagaa agcattagta gagactgccc agggaaagag gaatgaagtt
227351 aggaagcaca ggtttacttc aattttctca gaaaagcagg actcaccatc
227401 atctgaagag aacaaggta gagtaaaaga atatgtgttt gagcagagtg
227451 aaaattggtc ttatcagaaa acccacatgt ggctgggcac agtggctcat
227501 gcctgtaatc ctaagcagtc tggcaggaag taggaggatc ccttgagtcc
227551 aggagttcaa gaccagcctg ggcaacatag ggagaccctc tctctattta
227601 aaaaaaaaaa aaaatccac ataaatacag taagaagaaa agctaaaagg
227651 tgtgactcat gtacaccaaa tcctaagttt aacagttaaa gttccgctta
227701 tatccacaca attccactta tatctaaaca ataacaac gctaagtaca
227751 tgctatgctt ttccaccaac tgcccaattt aaggaataac aaaggatgag
227801 gttaagaaac agatcttgga gccccaagat tcgatataca gctagtatca
227851 taacaacaaa atgggcttag tgccataacc acaggcagat ggtgatacta
227901 ataattctca tatttccctg tccttctttg ctggatccat gttctgtttt
227951 ctccacaact ggtacgctta tgaaaagttc ttgctcaagt cagttaagaa
228001 cataagatac cttttagtaa aagaacaatt cccaccctgt tgagaactga
228051 tgtacattct ctttttatga ggtgtgtcat actccaattt tccaagtttt
228101 tacaaatttt cacttttcta caaatttattg aaaccagaac tatacaaaaa
228151 ttttatgttg gagaatcata ttattactgt tataaatctt taaaagtaca
228201 acttgtaagc tggtgctctg aagccaagaa gaaaaacagg atctaaagag
228251 aacacagaaa gaaaggacaa agaaagaagc aggctgagtg aagggacaga
228301 aaaccttgag ttataaataa cttggtttaa aatgtcaaga gaaactagtc
228351 tcaaagtatc tcttctaca gagttataat gcttttaat aatgaaagta
228401 cttcacatga caattttcaa agtcaaagcc atttatggca aacaaacaca
228451 tagcatttgc aatatacat attcaggtaa tttactgaat ggaaaaatct
228501 ctatggaatt catccagtaa ttatagtggg ttccatttat aaaacatatt
228551 ttaccacaaa tctgaagact tataaaacat gatctagtat aggagaaatg
228601 attataatcc tttaataact attaatcaca gaacaattag ttttaataac
228651 tataaccaca gaatggcatc ttgttttaca aataaaatac aaaccagtgc
228701 actgttctag ctgtactcaa tctaaacatg tcttttttatc tttttaatttt
228751 aaattaaatg tccattaaaa aagtattttt tattttctat gcttctctat
228801 tgtttttaaaa tcccagcccg gtgtggtgac ttgtgtctgt aatcccagca
228851 ctttgggagg ctgaggctgg tggattgctt gagtccagga gtttgagacc
228901 agcctgggca acatagtgag acctcgtctc tatcaaaaat acaaaatatc
228951 agctgggcat ggcggtgtgt gcctgtaatc ccagctactt aggaggctga
```

FIG. 5 CONT'D

```
229001 ggtaggagaa tctcttgagc cttggaggcg gaggttgcag tgagccgaga
229051 taacgtcact gcactccagc ctgggcaaca gagagagact ctcctgagaa
229101 aaaaaaaaaa aaaaagaaaa tccccacct ccctcttctc taattcccct
229151 ccccaagatt aagcactatt caaagtgcta tccttccaga ccctttttcc
229201 aggcatacgt agatgtatgt atttgtttga atacacacca agataatttt
229251 ttaaatgaga taatactata cacactgcat tataatttat tttatttctt
229301 tatagtagat cttggatttc tctacatttg gtagctctat ctcattcttt
229351 taaaagtgtt gcatggttgc acagtagatg cacttggcac tgaaaactcg
229401 acttaagtat atcccgagga tgaccctgaa tgtggttcac agttttgagc
229451 taaggaatct gggataagct ggagacccat tccttatcta tgaggaacat
229501 tcgagccccc agcctggctc atggaacaca gggcatagaa gggatcgagg
229551 tcctttgttt tgggttaaat gaaggttacc aggtggaggt tgttagggag
229601 aaggcattaa gtgaaaatgc tatgtaaact gcatgactgt tgcaagcagt
229651 tggttctctt gcctagccca ctgccactgg actctcttcc ctgtatgtaa
229701 actcccccca aaaccctctg tctcctttgc tggctctggg tctccttggc
229751 ctctagaacc tggtgccatc cccactggag ttgataggg ttcagcacaa
229801 attggtgttc cttaatattg ctgtactaca gtttgtttaa ccacttctct
229851 atatatagac atacaggtag gtgagggtgt tgttttttgt ttttgttttg
229901 ctatcttata atctatttta aaattagtca ctgataacat aaacaaatca
229951 gaatttaaaa acacaatgtt aattctcctt ggaaaaaaag ccataaagtg
230001 attatttgta ttattctaat aatacagata aataaaattt cctttgcca
230051 tttaaaaaaa aaaaaatggc aaaaaccaca attacttttg caccaaccta
230101 ataataagca ttttttttcat tttaaatatt ttggtttctc acagttgata
230151 aacatgcaaa atctgtcatt gttttcaata caatgttatc aataattctg
230201 aaaatttaca catgcaactc attttcaaat taactgcaca ttatggcctt
230251 tggatatgca ttggataccc aatgtgtttg agggctaaat ctcactaatt
230301 ctccactatt actcaattac gttaagccag cagtccccaa ccttttcgc
230351 accagaggat ggttttgtgg aaagccattc ttccacggac ctggaggttg
230401 ggatgcaggg gatggtttcg ggatgaaact gttgcatctc aggtcatcag
230451 gcattagagt ctcataagga gcctgcaacc tagatccctc acatgcacag
230501 ttcacagaag ggtttgtgct gtctatgaga ctctaattct gccactgatc
230551 taacaggagg cggaattcag atggtaatgc ttgccagcca gccactcacc
230601 tcctactgtg ctgcccggtt cctaacaggc catggacagg tacaggtctg
230651 cagcccaggg gtaagggacc cctgcattaa gcaactcttg attggtgttt
230701 tcagaagcct agtgtgatac taggttctct aaggaattca aaagaggtct
230751 gtgataaaag atctgtcttc aaggagcttg tacaactttt gtgaaaacaa
230801 aacaaaacaa aacaaaacaa aaaaccttag ctatctatat aaaatcatta
230851 cacctgaata caaagttttg aagaaaatac aaaaggaaga agaaatatgc
230901 aagggaccaa ggtatatttt accgtatttt atcataaggt aaaatataga
230951 gattacctaa gtgaggaaag aaaaggagta agtgaaagaa atgggacttt
231001 tttaattgta caaaaatcat agactttata aattcttcta aaacaacata
231051 tttcctgagg atttgttagc aaatacctaa gaaatgggaa tttagatgca
231101 ctttgaaaaa gtactaggat ttggatatag tgagatagaa aaaggaacaa
231151 tatcccagca taggaaaatt ttttagcaaa aatgcaaaga ctggaatgaa
231201 agtagaaaag ggacggaaag agaggtaggg aaatgggaga aaagaaaatt
231251 gtggttaaaa gggaaataca tagggaagtt tttgaggtgg agtggtggac
231301 agggagggca catatatttg ttgtcaaagg aagaagcctg gagagaggta
231351 aaaagctatt ccctgtacac ttggcccaac acgtttggt cccatttcaa
231401 ccaatactca ccctttaac tggcttctac aagaaatcca gatacaccaa
231451 gtatttcctg gcttttgtaa gttttatat gtgaggtcac agtgaagtgt
231501 cacaatacac gacatagcat ttctccagag ttcctattcc tttcctgctg
231551 gattttccct gtgcctttca gttttttctt cccttttta aacagaaaat
231601 ttaaactcta tctcttctag ttccaaatat gtattcctaa ctcatcctaa
231651 actgcaacaa aacagagact cttccaacgg caaggacata cctccttaaa
231701 aggcaattta acaaccgtct ccaaatactt gaacaaaccc tttgtggagt
231751 caacattcat cacaaatgaa ttatccatgc ttttcttcca aacaaattct
231801 gcattttcta tacaattctt aatgcttact aaaagattaa caatttctcc
231851 attgggatag agtcaaaact gcagatgaaa gatttgcctt agtaaaaaga
```

FIG. 5 CONT'D

```
231901 agcataatgt tataaaaaat gaatcattct tttcaagaaa tagaggcagc
231951 aacagttctt aaaattaaat aagaactaga agaatgtagt gagacagaat
232001 cttgtatact gctgagtaga acaaaatccc caggaacctt tctagaaaac
232051 aatttaccag aatattcatg cttttttaaca tatcaattct actaacaaaa
232101 agctatcctg agaaaataga gatggctaga tggtaaatga tgttattgca
232151 atgttattta caaaggaaag ccaagagtat ctacaaaagg gaaacagttg
232201 aataaattat gttatgctac catcttagaa tattatagac atataaaaat
232251 attttaagtg ccatatatag tcacataata aatatgtta aataaaaatc
232301 aagaaatagg actaatactt caaattcatt ttaaaatcat aaatattata
232351 tatatacaac tatgtgtgtg tgtacagaga catgcataat tttatataga
232401 taaaagacta gaaggaaata caacaaaatt ttaacagtaa ttttctctgg
232451 gtagtaagac tacagattac ttttttcttc tttataattt tctgtaacaa
232501 tcaaatttc tacaatagca tttataagtg gaaaatttgt tttaaaaaag
232551 gagcagcttt gtttcgccat taagtaggca ttaaaaaaaa atgtaggctt
232601 gctgggcacg gtggctcatg cctttaatcc cagcactttg ggaggccgag
232651 gtggaggtgg atcacttgag gtcaggcgtt cgagaccagc ctggccaaca
232701 tggtgaaatc ccatctctac taaaaataca aaaagttagc tgggtgtggt
232751 ggtgcgtgcc tgtggtccta gctacttggg acgctgaggt gggagaatca
232801 ctgaagcctg ggaagtcgag gctgcagtta gccaagatca tgccactgca
232851 ctccagtctg ggcaacacag tgagaccctg tctctagaaa ttttaaaaat
232901 aaaaataaaa aataaaaaat gtggccaggc gcggtggctc acacctgtaa
232951 tcccagcact ttgggaagct gaggtgggtg gatcatgagg tcaagagttc
233001 aagaccagcc tggccaatat ggtgaaaccc cttctctact aaaaaaaaaa
233051 atacaaaaat tagcggggtg tggtggtaca cacctgtaat cccagctact
233101 caggaggctg aggcaggaga atcacttgaa tctgggaggc agaggctgca
233151 gtgagccaag atcgtgccac tgcactccag tctgggtgac agagcaagac
233201 tctgtcttgg aaaaaaaaaa aattaaatta aaataaaatt aaaaatgtgg
233251 gctctgatat atttatgatc tatacactct acactatggt actggtgaag
233301 cctatagact tctgagtttc cattataacc ccatgttgag taaagtttta
233351 agggcacagg aagggtgctg atttggacct catacagaac aactttagtg
233401 acactagaat gtgagctttg tgagggcagg atgttggtgt gttttgctca
233451 ctgcttcatc ctcagcacct aaaataatgc tttgtacacg gtaggcactc
233501 aacaaatatt tgttaataaa tctccaacta atttttaaa aattataaat
233551 tactttcctg ttttctacta tgcctttttgt ctctaatcat aaggaaaaac
233601 agagaggaag tgctgacttt tagatgatga gtggggaagc tcataaagac
233651 agaactggag ttttttggtt ttcattgtgt ttttttgtcct acaaagcaaa
233701 taatgctttc tctcagaaag aagctcactc aggcttactc tgacatgttc
233751 aacttttacta ctgactttcc taacaagcaa agagcattta tgctgaacca
233801 catcttctgg aaagtcttgc ttttaccccca actgtctcac tgttcatgga
233851 tggggaggtg caactaaact gggttgtagt gaggacagaa catgtcactc
233901 tgttactggc tttagaaaaa gtagagccag tggcctatga ttccaaatag
233951 aagaactatt gcccttctac agaatgtgct ttcaaacctt gccctgacc
234001 cacaacaaaa aatacggcta acacaaaaac cccagtaaca agctaacatg
234051 tgtgcaagta aagcaaaagt ttcacaaaac aactgctctt accacatctg
234101 atgcagtctg atattgtcta tgctattcaa tttaatattt ttaaactgtg
234151 gattacagct cagcaaactg attttatgac ctactagtga gtggaaagcc
234201 acagtttgaa caatgctgac aaggagacag tgctttcttc ccctggacct
234251 gtaggcacta tgtaacggag tatctagtca tgaagaaaac tggctctgga
234301 gcctcctacc tgacttcacg tactgcctct gcaacttaca aggtgcctgg
234351 acaaattact taacctctct gggcccctat ttcctcatat gtaaaatgga
234401 aataacatac ctatgtcata ggattattat aaggattaaa tgaattaatg
234451 tataaagtac tcagaatagt gcctggtaca cagtgagcac tgtataaata
234501 ttagctaaga ttattattat taatgtgcct actgaggagg aaaaacacac
234551 actgagaatt aggtaagatg taagagaagg tcaagaggtc ctacgtatcc
234601 tgatgctctt gttagaagca gaaaagaaa actgataatc tcaaaatctt
234651 ctacatagaa ccaagcaaat gttagtctat agtaatttgg tgtttctctt
234701 tgatgcctaa atagatattt gaattagatc tcacagttta tgttggcatc
234751 taaaatctca ctggctctta tctgaaccca atccactcct gattaagata
```

FIG. 5 CONT'D

```
234801 atggttggat agtaatccat tcctgattag tgttgaatag ttaattttga
234851 gatagtgggc actttatatt ccaatttta aaatagcctt attgagatat
234901 catttacata ccacaaaatt tcattatttg agtataccag ccaatgattt
234951 taggggattg aggagagttg tgtaatcaac gctgcaattc aatttcagaa
235001 cacttccttt actcctattt gtatcatctg cctacttgca gtctgcctat
235051 tttaaatgag gaaaacaatc atgcattgcc aggccatcca aaaaccccaa
235101 ctaattcccg caaatatgac taacataccc aacttaacta tttaacacta
235151 ctgtaccaga tagaaattac attttccttc tacagtgaag ccaacatgtc
235201 ctgtaatgta aataaacaat agaataatat gttaacgata ttaaaaatat
235251 tatctaaatt ggactcaggc acctggcaga agcaaataac agaagcaaat
235301 aacggaagca aaaaccttca gggaaggaa agagaaaata acaataaaat
235351 acacctttgg gagcttaaga ggatggggat attctatcag gggaagactg
235401 aaataaaact gtaatagcct cttatgtttt ccccaagaag ttttcagcag
235451 tgcttacagg cagaattctt atcccatgtt ttcaatccag aaattaaaat
235501 ctgagttaaa aaaaccctg caagtcatta tgctaaatat tcagaaagtg
235551 agaataccca ctagggatgg ctataatgaa aaagacatac taagcactgg
235601 caaaaatgta gagaaactgg aactctcaaa cattgctggt aaaaatgtaa
235651 aatggagcag ctgctttaga agcaggtcaa tagttcctca gaaattaaac
235701 acagccaccg tatgacccag caatcccact cctaggttta tatccaagag
235751 aaatgaaaac atacacccat acaaaaactt atacatgaat gttcaaagca
235801 gcattatcca taataccca aaagtagaaa aaaaaatgtc cattaactgc
235851 tgaatggata aatgtggtac attcataaaa tggaacatta tttggcaaaa
235901 aaaggaatga agtcctgata cataatacaa tatgggtgaa aacactatgc
235951 taagaagcca gtctcaaaag gtcacatatt gtatgattcc attcatataa
236001 aatgtccaga ataggcaaat ccagagacat aaaataggtt catagttgtc
236051 tagagttagg agggttgaga ggaaagggga agtgactgct aagggttaca
236101 gagctgcttt gcaggaagat gaaagggttc taaataatt gtgaggatag
236151 ttacacaact ctgtgaacat actaaaaact actgacttgt acacttcaat
236201 gggtgttcta gaattctagg atacattaat tctatctcaa taaagcaaac
236251 acattttgtt tatttatttt tttgagacac agtctcgctc ttgtcaccca
236301 ggctaaagtg cagtggcatg atctcaactc actgcaacct tcccctccta
236351 ggttcaagcg attcttctgc ctcctgagta gctgggatta caggcatgtg
236401 caaccatgcc cggctaattg tagttttagt acagcccggg gtttcaccat
236451 gttggccagg ctggtctcaa actcctgacc tcaagtgatc tactcaccta
236501 gacctcctaa agtgctggaa ttacagacat gagccaccac gcccagccaa
236551 gcaaacatat tttaaaagca tcatttgcc atgtgctttt tactctttca
236601 cctcatgtat atttgaaaag aaccttatgt ttttaattaa tttacatttt
236651 attcatcaaa atgttttgtt ttttgagatg gagtctcact ctgttgccca
236701 tgctgggtgc agtggtgcga tctcggctca ctgccacctc tccctcccag
236751 gttcaagtga ttctcttgcc tcatcttcct gagtagctgt gattacaggt
236801 gcatgccacc atgcctggct aattttgta tttttagtag agacgcagtt
236851 tcaccatgtt agccaggctg gtctcgaact cctgacctca agtgatccac
236901 ccgcctcggc ctcccaaagt gctgggatta caggcgtgaa ccacccttag
236951 tcatcaaaat atttcaaag aactattcga taaatatcaa gtctttcaaa
237001 agttcttcaa aagcttattt tcctcctttg aatcataaag ttctattcca
237051 ctaaaaaata tgaaattcca gcctgagcaa catggcaaaa ccctgtctct
237101 caaaaaaata caaaaattag ccacatgtgg tggcatatgc ctgtagtccc
237151 agctgctcag aggactgagg tgggcggact gcttgagccc ggaggtcaa
237201 ggctgcagtg agtcaagatc ataccactgc actgcagcct gggcaacaga
237251 gagaaaagaa accctgtctc aaaaatagg aagaagaaga atgaaattc
237301 aaaatgtaaa atttccagtg cttgaatcac agttttcaaa ttcagcttca
237351 gtactgtcaa ttgcaaaac aacaacaaca aaaccccaa actttattat
237401 tttaatctat ttggttcata ttttgcaaga gatggtggat ctagaaaact
237451 ttaaccggga ttttatgacc ttccctccc caccccgcca aatctgaaca
237501 aagagctcaa actacttttt ttccttcttt tattccatat catatagaag
237551 aatgccacag ttgcaaaaga gcaagctatc tctaaatcc agggcaaga
237601 tcagcaatcc cagtacttaa gtcaaagaa tcaataaaca gtaaatagga
237651 ttaattaaat tcattctatg tttcaatttg tccaggtttt aaacacatta
```

```
237701 ttcaatcaca gccatcataa aataagaaat attatattaa acgcattaac
237751 tttagattag aggatgacaa gtttaaggaa gttgcagaca tccatttaga
237801 tatctgtgaa aggacaatta ttttaatatt ctttaatgta caagatttta
237851 ttaatatttc tacagcactg tcaagaaaaa aaggaggccc caatgaactg
237901 acaagtaggc taacatatag atttgtcttg ccatatttct ctatgtaagt
237951 aaattcagtt ctgaaaaata atgcataaat atactttaat gatacaactt
238001 catttatcct caccttgttg actttttcat cttatgttcc caaatctact
238051 cctctgctgg gttattagca ttttgcagtt atagttatat attttatcaa
238101 tgtattagag acagctaatt gccttccaat atctgttctc cacttcttcc
238151 ctaacaaaac gctgtttatt tcatcacttt gccaaacagt ataaaagctc
238201 aattttccag gctgtcgcct cagcttccca agtagctgga atgtcagcta
238251 aaggagtcag tgtgacttag tcctggacaa taaaatgcaa gtaggggctt
238301 ctgggtagac atattttct ttattcttct aagtaaaacc aaaagccatg
238351 tacattatgt ttattatata aaatgtgttt gctttattga gatagaatta
238401 atgtatccta gaattctaga acacccatta ttctaacttt attagaaatg
238451 ctaagcatca gtattactgt tggaattacg agaatttgaa agatagctgc
238501 atataaggtc aagaatcagt aagtagaact acaaagcaga aaaaaaatta
238551 ttacatttaa tataacagta aattctaagg gacttagaaa taaatttagc
238601 aagcgaagaa cacatctgca tgaagaaaaa aataataatc atatctaagg
238651 gcaaagaata agatctgaac tagtgagcaa aatatctgta cattatattt
238701 caactaaaac caaaaggatt ctgaaggtg gagagacgac aaactggcta
238751 gggacctcag gacccaggag aaaacatggt aatgatatcc tgaattttct
238801 tatttttgct ttctatatcc cactctggat actggtgaag ccagcaaccc
238851 aggaacacca agtgcaaaga aactgcctcc cctctctgcc cgcccctgga
238901 aaaagactgc tttctctagc caaaggaaca tgaaaggggc agcaagacag
238951 aaaacttaaa ggcaataaat aactccagac aaacaccaca gaaaaaagtg
239001 aaactccacc cgaccccccac cagcaaaaac caagtggaaa gcctagactt
239051 ccatccctgt ctggctgtaa gaggaggcac cccaagctct ttccctaaat
239101 ggggaacaag gggaaagttg ggacattcat cccccttgag catgatctaa
239151 tatccccctt cccatctgcg ctagtggaga ccactttagg agcctggact
239201 tgcagcccac gcatcagtca caaggtgctc ctcccccgac tgcaggagtg
239251 gtgccagagg agacttgttg agtgctggac tttcaccacc acttagcagt
239301 accaaggcct cccctccaca tggtgtcagt ggaggtccat cagagagcag
239351 taataaggca ctcctctacc tcctaatgag aggggtacca gtggaggcct
239401 agtggagagc ctgaacctcc tcctctaccc agcagtaaca agcaaacccc
239451 ctccccctagg tggtcaactg agaacaggga gagaaccaag cccctctggt
239501 ggtaatgagg caaccctgtc tacccccagc agtagtgttg gagggtgcct
239551 gctaaaacac agatttaagt aagacccaga gtcttataac ataatacaca
239601 caaaaaataa taataataca caaatgtcca agtttcagtc aaaaatcact
239651 tatttaatca caaagagata taccatttgt ttgatggggg cggggagaga
239701 gggataactt ataccaagaa ccaataaaga tctcaaactg aatgattaaa
239751 gacaatcaaa agatgtcaac actgagatga aacagcttga ctgtgcaaca
239801 attttctttt cctctcaaaa tcttctggcc cttcagatta acactccact
239851 gacattgcac ttatacagta aaagccttta ctaatttata aattataaac
239901 tttgtgataa aggaaagagt taagtatttc caaggaattt tagcccaagg
239951 aaaagtcggc atttaaaaat ttatttctgg ccgggcgtgg tggctcacac
240001 ctataatccc agcactttgg gaggcccagg tgagtggatc acttgaggct
240051 aggagttcaa gaccagcctg gccaacatgg caaaaccttg tttctactaa
240101 aaatacaaaa agttagttgg gcataatggc attagcctgt cttcccagct
240151 actcaggagg ctgaggcaga agaatggctt gaactgggag gtggaggtta
240201 cagtgagctg agattgtgcc actgcactcc agcctgggag acagagcgag
240251 actctgtctc aaaataaata aataaatata attttaaagt gtatttctcc
240301 cttaattttt ttttttttg agggatgagt ctcactatgt cccccaggct
240351 ggtctcaaac tcccaggttc agtgatcctc ccacctcagc ctcctgaata
240401 gctgggacta taaatgcacc cggcttccct tactttttta tttcttaaac
240451 ttaccgttga ttagaagcaa ccggaatgaa ttccttgcac ttctcaaatt
240501 tattattctc taatattagt taccgtgcaa ttcttacaag accaaaagca
240551 ttttaaaagt caatctttaa gtattaaaaa atatactgga aagactcacc
```

FIG. 5 CONT'D

```
240601 aaaataattt atgaatgaga tgatactagg tcatttttaa gaacactaga
240651 aaatgttatt tttacattct cagtgtacag aattttttcc aagttatacg
240701 taaaaactag gaaaaaacaa aatccacaga cctaatgcag aaatgtgata
240751 cagcttgggt gaggataaaa agaggaagaa acagctgtgc tactcatgaa
240801 ggactatacc atagatcatt gatgctctat cattagtatc atcaggatca
240851 cctggacggc aggtgaaaca gattactggg tcctttccgc agaatttcag
240901 attaaataaa tctagggcag gtgagaattg gcatatcaaa caagtcccca
240951 ggggacgttg attctgctgg tccaatgacc acatttgag  aaccactgcc
241001 ttaaagagat gatgcctgtg cagatcacaa aatataataa taaaggtcag
241051 ctactggaag cctaactcta gtgaagcaag cagaacagct gtacctaatt
241101 ctgaattaag agtaagaatt agaggccagg gacagtggct cacatctata
241151 atcccaacac tttgggaggc caaggtggga ggatcacttg aggccaggag
241201 ttccagagca gcctgggcaa cagagaaaca ctcccatccc tacaaaaaat
241251 aaaataaatc attttttaaa aaagagtaa aaattagtag gagagaaagg
241301 gaagtcagac cctaagttgc tgtaaaggta aagttcata aaaaccagaa
241351 aataaaaaca agtaagcaac tctcttccca tacacgacaa ccttattaat
241401 gcatttattc aacatttatt gaacaagaac tatataccag gtacaacaca
241451 tggagaacac aaacataaat aagcattaac tgctaaagag ctcatcatct
241501 ataaggtgaa acagaacaaa aagtaattgt agacctagaa aagttaagga
241551 atttaactaa aatgacaaac acagaaaaat ctgttcggca aatttctaag
241601 ttataacttc aatggcattc ttattctttg gtgacaggaa agaaaaaggg
241651 agcaacttca ctctattaac aataaaaatc tctaaaaata gaataacaag
241701 tccatactga cataagctat tgaataataa ataaacggga gagaagagac
241751 aatctcctgt gcagaagaat tccaagtaat tagcaggtgg aacataactc
241801 cccactccct gagtgtaagt tatagatcgt gacttctttc cagagagcag
241851 catgaaaaga ggggtaatgg aaacctgact gtgggagaaac ctcaccaaca
241901 ctacctcacc ctagtgatca aggtcaacat caacagtgat aagtcacatt
241951 gacagtatgt gatgaaaatg gcactgcgct tctgcgatct tcctcaaaac
242001 tcgtaacccc agtctaataa agagaaaaac atcagacaag ttcaaattga
242051 ggaacacttt tacaaagcac ttaaccaaca cttctgaaca ctgtgaaggt
242101 cataaaaaac aaggaacgtc tgaaaaactg tcacagccaa aaggagccta
242151 aggagacatg atgactacat gtaacgtggc atcctggaac agaaaaggct
242201 cattaggtaa aaaccaagac aatttgaaca aagtatggac tctaattaat
242251 gataatgtaa aaatgtatca gtattagttc attaattgta acatgttaat
242301 atgtaacagt taataaactg gttgtaggat atatgggaac cctctgcacc
242351 atcttcgcaa ttttttctgta aatctagaat ggttttaaga aataaaactt
242401 attttaaaac ttgagaatta acttctcaga acactaattt agttttttaaa
242451 agtcaaaaaa ttccaatgat ggaaaataaa ggaatacatg aatatattat
242501 ggaataaata agtatatgga gatttgctcc tgacaggaat ttctaaataa
242551 gtttaatgta tatttttataa tgagaggatg ggaatatcaa attatatatt
242601 tttaagttaa tggtactgag ttcatttcac cagaattaca ccattataaa
242651 gctacgattg acaaaatcca caagaatgca ttaagcagaa aacacggcca
242701 aaaacttttc agtagtaaaa ctaatttaaa atgtaacaag cacaaagcaa
242751 ttccaattaa ataaataatg aaataggatg tcagtttaga aaagaatgaa
242801 tctgaattaa tatttcacaa tgcacatggt aatatatttc aggaggttaa
242851 aaaagtaaac ctaagaaaag tcaaaaaata actaaacagg agaacatttt
242901 tttactttac cttagaagaa aaatttgagt cctgaagaaa aagacaattt
242951 caatattgaa aacttttatt tttacatgaa aaataaaaac tttttatgca
243001 atcaataaaa caaaaattat aggaataaat gtaacagact aggagaaatc
243051 attacaaagc ttgctaccca aaatatccat atacaaaaat ataggcatat
243101 gtagaaaaat acatatgtct atacacacgt atatagagat gagtataaaa
243151 gttcagttgt gcattgccaa gggataatt  tccaagtagg aatacaataa
243201 atgaatcaag acatagcaaa atgcatagct ctggtagcaa aattatttgg
243251 taaactatgc aaaaacaggc acaaagctaa aaatatttac tatttggctt
243301 tttacagaaa aggtttgcca accctgggc  taaagaagca agttaattca
243351 ctgacccaca caatttttag tgaggttgag atagtcatta cagacaatcc
243401 ttttcaaaaa aggagggaaa tgcaaagtac atagaatcag gttactaaaa
243451 tacagaggga aatgttggaa atctggaaat tcgttaagac tcagtcctat
```

FIG. 5 CONT'D

```
243501 ttccatcggg aaatgattct ccatggctct gggatccatc ttccaggttc
243551 agccctctga gacactcttt cttttaatg aaaggtagca cttgctttct
243601 gctaagcagt tttctcatca tgcttcctac ttgtagaagt ttgggggtcc
243651 aaaggcatct tttcattttg tactctctga cccctttaat ccaaactagt
243701 agtgatcctt aaaatacatt cctcttaaag ctttgtgggg gtcctaggaa
243751 tctcactggg gttctttgca ttaaacaaaa gccacacgca caaatctttt
243801 tcagataagc cctcctctac cttgagattc tgctgaaatg gctgcaggat
243851 aaggaccatc cccttaagtt tcttggacgc gctattgttt gattgaatgg
243901 attggtcagt cacaccatta gtctttcttt agaggcccct ttatgtgact
243951 gaaaagtact ctgaggcaga aacttagatc tttcttaaat tttaacaaag
244001 gattttacag ccacactctc aactttgtcc ttagttttcc tgacaatgcc
244051 ttggatctat ctgatccttg ttcaagaagg aaaccagaat atttcaccct
244101 aaaatatgct tctttaaaat atttttttt tgagacgga gtctcgctgt
244151 gttgtccagg ctggagtgca gtggcatgat ctcagctcac tgcaagctcc
244201 gcctcccggg ttcaagccat tctcctgcct cagcatcctg agtagctggg
244251 actacaggcg cctgccacca cacccggcta attttatat ttttagtaga
244301 gacggggttt caccgtgtta gccaggatgg tctcgttccc ctgacctcgt
244351 gatctgcctg cctcggcctc ccaaagtggt gggattacag gagtgagcca
244401 ccgcgcccag ccaatttatt gctctttatt gaagattttc tatgagctgg
244451 gattctaaac cactctaagc cactcttgag ttactttct ctcatgtgaa
244501 ctgcactgca gcattactat acgtgtttgt ttctctcttg ttcatctgtt
244551 ttttgctgca ggagtctgtc ccaactacga acttatgaag gttgaggaaa
244601 attattattt ctcccttca cttagaagaa gccatttctt aatttagcat
244651 catttactgt ttggagaggc tgacatggtc aaaactatca agtctcagca
244701 ccttcaggtt tatcaatcct ttctttagca tacttgctcc tgtcactctt
244751 taggcacaaa ccaggtggca ccttcaagtc tagttggaaa tcttcttagc
244801 tacggtactc agttcattat gtgcattcta gtttctacat tactacaggt
244851 gacagtgttg cattataaag cttatgctac tatattagaa ggatcccctt
244901 tcctccagtt tctaaaaaga ttctcccatt ttccttaag cccttcctgg
244951 caacctcacc aaaaaaacat gagtctacag tttctccaag atactttaga
245001 tttacactga cagtgtcttc aatgtccatt caccttcat ccactacgaa
245051 gttccaaagc catgcccact taaaatattt gttgctgggc accatggctc
245101 atatgggatt gttcccaaag caatcccagc actttgggag gccaagcagg
245151 aggatcactt aagcctagga gtttgagacc accctgggca acacagtaag
245201 accatatctc tacaagaaat aaaagaatta gctgggcgtg gtggtgcaca
245251 cttgtaatcc cagctacttg ggagactgat atgggaagac tgctttagcc
245301 caggaggtca agtctgcagt gagctgtgat agcatcactg cactccagcc
245351 tgggcaacag agcaagaccc tagctcaaaa aaaaattgtt gacatcactt
245401 atcttacttc atttgaactg ctatatcaga ataacataga tgggtggctt
245451 ataaacaata taaatttatt tctcacagtt caggaggttg ggaagcccaa
245501 gatgaaggtg tcagcagatt cagggtccag tgagggccca cttcctggtt
245551 cacagatggc catcttttcg ctgtatcctc acatagtgga aggcgaaaca
245601 agctctctca ggactcttac aaggacacta atcttattca tgacagctac
245651 accctaatga cttgatcacc tcctaaaggc cccatgtcca aataccatct
245701 cattagggat taagtttcaa cataggaatt ttgtggggac acaatcagtc
245751 tactgcatca atcaacctct agtgccagta tcaaattagt tgtctactgt
245801 gtaacaatta tccaaaactt gtaagcttaa aacacatagc ttaagatcta
245851 ttatttcaca tagtttctga gagtcaggaa tccaggagta gttagctcaa
245901 tggttctgac tcaaatgtca gcctcaggca ggaatgcaat catcatgaag
245951 tttgactgga gctggaagga ctactggcta ctggctagag gctttggttc
246001 tttgctgttt gggcctctcc atagggatgc tcacttgact agcttctccc
246051 agagcaagtg atcagcaaaa gcgtgataaa gatgaaaact gcaatgtctt
246101 taataatcta atcttaaaat taacattctg ctgttttta ttggtcacac
246151 agaccagtct tggcacagta tggaagaaga atgaatccac agggcgcaaa
246201 taccagcagg tggtgggggc catcttggag gctggctgct gcagtggctt
246251 ggcaattcca ggcagagtct catttacaac acccaaataa ggaaggaaag
246301 aaacagggag ggaaaggggg aacttcttca cataacttct cttttcttag
246351 ggggaaaata ttgttcaggg agctctccaa taaacttcta tatctctttg
```

FIG. 5 CONT'D

```
246401 gcctgaagag aataaaacag ttacccacta agtgccaagg agcctagaaa
246451 aataagtatg tggcattttt tgcctcaatc ataaaaagaa agcaggaaag
246501 taggaggttg gtatgacttt tgcatagaca acggtctacc acaaaagtta
246551 agtaaaaagc atagcaaaga taaacaagtc aatgattaca atcacatatt
246601 ttgaatatat atttctaaat tccagaaatt aaatggttta cttcaaagat
246651 gtctgaaaat ttgtttttaa gttgatataa atgtaaacaa aaaatgctaa
246701 attaatattc ctcactataa ttatatagca ttttataata tccagactgt
246751 tcatatgtat tcttacaat agccttgaaa gaaaactaaa gcaaatatta
246801 ttatgttagc cccactttac agataagaaa catgaatcaa tggtatgacc
246851 atagctcact gcagccttca actcccagac tagagtgatg ctcctgcttc
246901 aaccttccta gtagctggcc ctacaggcat gccaccatac tggctaattt
246951 ttaaaatttt tttagagatg aggtcttatt atgttgccca agctgctctt
247001 gaattcctga cctcaagcgg tcctcctgcc tcagcctctc aaatagctga
247051 aattacaggc atgagtcact gcacccagca aaaattatc attttgaca
247101 acactaatac tacagtaatt tgcttaaccc tctatcactg acattaggtt
247151 atttcccatt tgtcactctc atagtcaatc ctatcaaaat attttcatgc
247201 attattttc cctccttact tagtttattt tattaggaaa aaataccaca
247251 aattggctga ctgggtcaaa acatacatac attttttaga accttgctat
247301 atgctgattt ctaaaagcaa tttaatatag tttagttaac taaagatgct
247351 accagcatga gtataccatg aggttcacca aaacctcacc atccccaagt
247401 acctcgttga attcttgctt atttagaatg aaataaaatg ttctcttata
247451 gttttaattt gcatttattt gattacttgt gggattgaac actccttttt
247501 gtgtttttca ctttgttctt atgagaacta taaattcata tctgtatttc
247551 atttactata gtcttgagat ttttcttata aaatttaata agttatttct
247601 cataaacatg ctttgttatt tggttcaaat atttcttcta atgttacctt
247651 ttttattttg gtttaaccaa cattcatttg tacaaaaaaa gttatataat
247701 aattctattc tataaaatgc tcttcagtgt tttgtttgt tttttcactc
247751 caaaatggaa aagttactag ctgtccaaaa agttgataaa catgctacca
247801 gctataatac ttattctcct tttaatcagc ctggggttta ttttgatcta
247851 tgatattcaa tttaaattta gttgcacaat tcaaaaattg cacttaacta
247901 aagatgccct tttgcatgct gctaactgct atagatagtt gggcggatta
247951 agataaccca aataatgtgg aactactata aataatataa atgctgtgaa
248001 tttaactata aaatttgcca taggaaatca gtaaggcata cgtaaacatt
248051 acctaaaaga gacaaaacag ctcccagacc cacacaaggt ggctataacc
248101 taattgaaag tgctctaaca ttatctattt tagaagacaa atgggtcatt
248151 cagaagggc actggtcagc cactggcgta tagggcaggg aaaaaagtta
248201 ctgggttttt ctccttttc aattaattct tcctactaac tatacatttc
248251 tttttcacc aatcatttc aagagttttt tagcttcctg tgttgttat
248301 gtggtactcc cactctcctt tatttaggaa gttaatgatt ttagttattt
248351 cttatttat cctagagact aaactttttc tcaagtacac tctaggtgag
248401 ttgtctggtc tcagggtctg gatgtttctg atctggaggt gagactggta
248451 tcgacatggc tgcctaaggc tatctttgct gatgttatca aatctttgaa
248501 gcctaattcg taattcctgt taataccgca agtgtcatac ctgttctctt
248551 cctatttca tagaattgca ctgaaaggct taatagtcat ataatccaaa
248601 tagaaactca atctgcaagc ctttcacatg aattattatc aagacatgtt
248651 cctctattca ctgtttctat tttctggctt tgtttcttta aaaagtgttc
248701 tgttaagaaa taattaacaa taagctgcac atatttaaag cgtacaactc
248751 aaaaagtttg gacatatgtg tatttacctg tgaaaccatc atcacatcaa
248801 gatagtgaac ctcctaaatc tttcctgtcc ctttgaattc ctttcctccc
248851 tttccttgtt gtctcctctg catttgatat gcttccattg caatacagca
248901 cttatatttt tcagaacttt taataagtgt aatatattct tttttgtctg
248951 gcttctttca catagcgtaa ttgttctggg gttcatccac tttgttacaa
249001 atattgctga ggagtattcc attgtataga tataccacaa ttttgttatt
249051 caattacctg ttaataacta ctttggaaaa cggttttagc agcttcttaa
249101 aaaataaaaa aaggctgggc gtggtggctc acgtctgtaa tcccagcact
249151 ttgggaggtc aaggcgggtg gatcacttga ggtcaggagt tccagaccag
249201 cctggccacc atggtgaaac cccattgcta ctaaaaatta aaaaattacc
249251 tgggcttggt ggcacactcc tgtaatccca gctacttatg aggctgtggc
```

FIG. 5 CONT'D

```
249301 aggagaattg cttgaacctg ggaggtggag gctgcagtga gccaagattg
249351 caccactgca ctccagcctg gacaacagag tgagactctg tcttaaaaaa
249401 aaataaaaaa caaaaaataa aataaaaaac aaaaagtaaa aaaaatctac
249451 ctaccattcc attcccagga attcactcaa aagaaaagaa tgcatatgtc
249501 catataaaaa cttatacatg aatattcata gtatctttat ctgtattagc
249551 taaaaattag aaacaattca tctccatcta cacagcacag ataaacaaat
249601 tgtggtatat tcataaagtg acatactact tggcaataaa aaggaataaa
249651 ctattaatat acattacaga caatacagat aaatctcaga ataactaagc
249701 tgagtaaaag cagaacaaaa aaacgagtat ttatttcttg ccaattcttt
249751 ttttaatgta cctggtcact ttatagcccc ttactcttta tttattttat
249801 aatccctatt ttatttattg aacatattaa actatgtaca tatatacata
249851 tttagacata catacaagct cttgatctgt tgcccaggct ggagtgcagt
249901 ggtgtgacca tggctcactg cagccttgac ccccaggctc cagcaatcct
249951 cccacctcag cctcctgagg tacgcaccac catacccagc taattctatt
250001 tattgtagag acagggtttc actatattgc ccaggctggt cttgaactcc
250051 cgggctcaag cgatcctctt gcctcagtct cccaaagtgc tgagattata
250101 agtgtgagct actgcaactg gccataaaca tatttatttc atgtaatgta
250151 tatttctaat aatcgaaatc tctatagatc tctttcagtt gtttgctgtt
250201 tctgctgact cttgctcttg gtgttttgat gttttctccc ttgttacatt
250251 ttgtaatttt aaaaaatgtg tatgagctta tttgttagaa ttttaactac
250301 aattatttga tgaatgcatt gatcgtacat tcctccatgg aggattttt
250351 tattgttctt acaaggtacc tgagagtatt acagactgag gtccaattta
250401 aattaaaatc ctccacttgt ggagttttag aaactgtaaa aattgtgtaa
250451 attaaggccc caaattcaag tgaatgtgag ctgataacca agaattatta
250501 gggaagattt taagtctacc cagaactgaa tatctttgca agatggtctc
250551 tgaccaggct tcttaccttt atatgggacc cagggatctt tttctctagt
250601 cctcatcctg ctccttacac aaagcttcaa tgccaacaga atccatgga
250651 tgcccccaaa gtattcaatg acttcagcac ctgcttatct cacaggatat
250701 attatacttg ttttgtttct agccccagaa agtttccctt attttcttaa
250751 tgggctcatc cattcatgtt aaaggatatt ttttatactg aatctagtac
250801 tttacatgtt tggtggaggg aggaattcag gctctctagt ctatcatatt
250851 gctacaaatc agtctactat ttctgcaact gctttataac atttaaatac
250901 aatattatat ttattcctga tacattttat tttggtatgt tgagcatagt
250951 ctacacgtct gtcgagagca cttaaaatct tgattgagtc atcatactag
251001 cttaccttag aagttgtata tcatttgcaa atttgtttga accttcttag
251051 ctttcaccaa agtcactgat caccacagct tctgacaaaa agaaaagctt
251101 taaaattaat ttttaaagtc tttatagtaa atccaacata ttttcttatt
251151 gctttcaggt atacagaatt acaaattaaa tttccatcat aatcaaatac
251201 taatacatca aattaaaaca ggtaaatttt catatcccaa taactcaagt
251251 ggcagacctt tcaaacagta gtattgaact gaatgaaaaa tatatttatc
251301 atcaagggaa accagtggaa acataaagcg ttagtttggg taaagggcgc
251351 tctagtacct ctgaaatctc caacagcccc catcttcaaa aggaagaaac
251401 acaatttatt taaactagta tcttaaaggt cagtgtttac aaaaaggctg
251451 tgggaaggct ttcctgactg aaggatgctt tcttcccctt agatgttcag
251501 taaaatttta gctctttcat atttctattg tttcctagca caaaacatag
251551 aagagcactg aagggtcata aagggaagct ttgaagggtt tcttgcttt
251601 aacaacatca tgaaaaccca tgcctgctag attttttctt ttctactcca
251651 ccactttag ttcgcacctt tactaatttc agtcaccagc gacaatttct
251701 gtaaaatcta tctccatcac aagagtgtgt atgcgtgtgc ttgtttcccc
251751 atcagaaata agagaaaact tacgcttctc tcctttagtg cattgctctt
251801 gcatgaagaa tgaacaaacc actgatttgg ggttcgcatc tttacgttct
251851 gaacagcaac ttagaacact tgctcctga tattctttct tctcaatatt
251901 tgatggatat cctgcaataa tgtaggaaaa acagcacagg ctttggagtc
251951 acatcaatct ggtttaaat ctcaatcttc tacttagtaa ctggctaatc
252001 tgaagcaaat ttttaatctc tctgaaccta gtgggaaaat aagatgggtc
252051 tcaatgtaca gctgcaagaa acaaatgata tagcatatat atatagtgtc
252101 agcaaagtgt ctaccatata acacaaactc tattatgtta gctttcctgt
252151 gtaatttat gcttcatttt cactttactc agtcaaacga atttccagac
```

```
252201 taaattttct tacgttatag ccttgataaa ttttatggtt ttgtccaaca
252251 actatcaaca ttttaggcca ggtgtactgg ctcatcactg taataccagc
252301 actttgggag gccgaggcag gaggattagg cctgggagtt tgggaccagc
252351 ctgagcaata tggtgacacc ttgtctctac aaaaataaaa ttaaaaaaaa
252401 taaaaaataa aaacattttg caacacttaa tgccttcaaa atagcagcac
252451 atcaatacta ctactactac tgaatatatc ccaccaagaa agtacatttc
252501 aaaatctatg ttctagagcc actagaattt gttccttttt gtgtgtggtt
252551 atgtcaccaa aatgcgatat agatgtgtaa acttgtttca tttcctttc
252601 agatttttct ttcattctac ttttttattt aatcccactt ttgaatatgt
252651 agacatacat gatgatttag ggttaaaact atagaaacaa cttccattta
252701 gagaaatctc tcttctgttg ttggcacctt taccctgctc cttccttctg
252751 cggatacatt gcatactttt ccatgccttt gttttttcca cttcctattg
252801 tattctacag atcattctct attggtatat agagactttc tcccttcttt
252851 tttatgacct ctatggaaag acggtgactt ggaaggggca caatctacct
252901 gcagactgtt gtactgtctg gatgcacctt agtttatgca atcagttctc
252951 tattaatggg cattttagtt atttccaatc ttttgcaaat gcaagtaata
253001 tgctgctatg actaacctcc ctttgactat tccctcccat gcagtttatg
253051 cttatgtatc cttaccagca atgtatcaaa gtgcctattt ccccacagtc
253101 tacagggcct attgtataac ttttggattt tgttgaaaaa tgctttaaca
253151 tagctttaat ttatatttt ctttgtatga ctgaaggtgg aacatctttt
253201 atttttgaga tgaagtcttg ctgtgttgcc caggctggag tgcagcggca
253251 tgatctgggc tcactgcagc ctccgcctcc caggttcaag caattctcct
253301 ccctcagcct ccccagtagc tgggattata ggtgctcacc attacaccca
253351 gctaattttt gtatatttag tagaggtggg gtttcaccat gttggccagg
253401 atggtctcaa actcctgacc tcaagcgatc tgcccacctt ggcctcccaa
253451 agtgctaggg ttataggtgt gagccaccac gcccagtctg aacatcttt
253501 tatatgtctg tcatgtgcat ttcttttca tatctttggc ccattttcct
253551 actgggttga tggtcttact tgcctggaat tttacgaagg tgttttcatc
253601 caggaggtta gctctttgtg atataagtcc aaatattttt ccccgctttg
253651 tcgcttgcct tttgactttg ctcgtggcat ttttcactat ttaaatactt
253701 ttttattaat atagtaggat ttatcatggt ttttctttaa gaatgagtca
253751 tagttataaa atctttggct tatactttcg tagactttaa acatgttgtt
253801 ccatggctgt tttgctttgt atgttgctgt ttagaagtct gttgctaacc
253851 tctccttct gtctggaagc ccagaggaat ttttcttcat cattttgaaa
253901 gtccaactgt tttactagga catgacttgg aactgaccat tctggatcaa
253951 ttttcccagt acacaatgag ccttttcaac atgtagattg gagtcatctc
254001 ttatttccag aatgtttca tggattgaaa cttaactatt agctttgcta
254051 ttgtttttt cttcttagga actctacttt tacttatttt ctatatcaat
254101 cactttctat tactttttaa cctttcttca tttaattttc attatcttgg
254151 ttgttttcat acctttctc aatgctcctt atattcagtc caatctttc
254201 ttatgtacct tggaatttag cttcattct ttctttatga cttttttttt
254251 tttttttt tttttttga cacaggagtc tctctatatt gcccaggctg
254301 gcctcaaact cctgggctca agcctctcaa atagctggaa ctacaggcat
254351 gcaccactgc atctggcttt aacttcattt taaaagctga tttttctttt
254401 gatttatttt atttcctgag ttcagtaaat tcactttca tatcttcctc
254451 ttttgtcca tttgttttgc agttttgaat ttggatttga gactttttat
254501 ctctacaaat gttagtttaa ggatattta aattctggta ggagtactgt
254551 gctgtagttt tctttagtgc tatagttgga tgtttcggga agactttca
254601 tcagctaaaa ttttttaaaa actttttcc ttatttttg tagagactag
254651 gtctcactat agtgcccagg ctgggctcga actcctgggc tcaagtgatc
254701 cgcccacctt ggcctctcaa agggctggga ttacagctgt gagccactgt
254751 gcccagccca gttgaaatgt tttgactatc attttgtttt ccagctaaag
254801 taactttata tggatgttgc ctgccatctt ctgttcatct tgaaatattt
254851 tattttcct aaaccagata tagttgtgta taggcagaag caaggaattt
254901 agatgactta actggatttc ttagtaaata gtacctaata aagtgttttt
254951 ttgtttgttt gtttttaatt aatgactcct ttttgggtgg gagaaatgag
255001 tatctatttt ctattctggt tcaccaagat ccttaatttc tactacccct
255051 tctctctatc accaagcctc caggtagatg gtgacccttc caaggcaccc
```

FIG. 5 CONT'D

```
255101 tctttccttt ccccagaagc agtactttca tgagactgcg tctttggtct
255151 catttctttt caagtctctt attttgtcta atggatctta cacctcttct
255201 cacttctcta tccagggtgg ggctttctct ttctgggaat tatctgtatt
255251 ctgctacccc taggtcctgc aacctctcct cttttttac agtctccacc
255301 ttgcttgcca cttctccatg gattctgcta gactgcagtg ttgatttccc
255351 tgcatgccca tagacatttt gctagctatt aatgtatgct tacatatcaa
255401 taaatttgta tgggttttct cttgttaacc tactgttagt ttagttcagc
255451 caactcagtt atcaaacctt cagaagcgaa atttaagctt ccctgcaaat
255501 tgctggttat tatttaatat tattttgaca cagggtctca ctctgttgcc
255551 caggctggag tgcagtggcg caatcacagc tcactgtagc cttgacctcc
255601 tgcgttcaag agatcctccg acctctctca gcttcctaag tacctgggac
255651 tacaggtgtg tgccactacg cccagttaat tttttatt tttattttt
255701 ttaagagaca agctttcgcc atgttgccca ggatggctgg tctcaaactt
255751 ctgggctcaa gcaatcttcc tgcctcagcc ccgcaaagtg ctgggattac
255801 aggcattagc caccgtgtcc agctggtatt attttatta gtgttctatc
255851 ttgcacttct gagtatgttt aagcttccac ctgtcagctt caagggcttt
255901 tttctcccag ctaatgccta aaaggcaaac aaccttattc tacttctcat
255951 tcaccctcct cttttcctcc catttttttg cgggttatat tatttctaca
256001 atgtcagacc atgtaatatt tatatactat tctatcatca ttatcctcat
256051 cttttaatct tgatgctaca cacaaaatat atttgatttg ctcaccacct
256101 gaccttatgt tgaagatttt ccaatcattt cttggttgtc tgaaatttgt
256151 tctctagtat acgcttcaga aggattcatg ggaacaatta tagccatttt
256201 ccttgaatta tttcatgttt ataaatgttt gtcaatgccc tgaattcttg
256251 aagggtagtt tggtgagata ggaattattt tatttctttg aataaatact
256301 ttcttaatat ctgacataaa atgttgccac caaaaatcca atctgatttt
256351 ctttgcaagt gacctgctct ttttatttcc cccatcaatg caagaagggt
256401 ttattttaa aaatccaaca attttacagg accacatctc agtgttaact
256451 gttgtgggtt gatttctcca ggtttacagt atgcctttca acatatgtta
256501 catttaaacc tactttaatg ttaagcgttc ttgaattaca gtcctaatag
256551 ttgttctggt ccattgcttt ggcttgcttt gttttactgt agtaaaataa
256601 ggaacataaa atttactgtt ttaaagtatt caataagtgg cattaagtat
256651 attcagtgtt acataaacat caccactatc cttgggctta catttgggga
256701 actccattta tatttattct ggctctcttt gcctgtcttg tcacctcttg
256751 actccttttt aaaaatcttt ttatttcttt cattttcca ttttcttat
256801 cgtactttct gtgatgtata ttcactcttg gtttctaatg caatcatcac
256851 tttaaactgt cttttcctta atcttttatt gagttttgtc tgctctcatt
256901 gcacctcctt ctatggtcta gccatctcat ttctttttt ccctgaaaa
256951 catagaaaga ggtgaatttt atttacttt ttataatttc aagttctctt
257001 ttagatttgg gggtacatgt gcagatttgt tacatgggta tactgtgtaa
257051 cgctgaagtc tggagtatga cagatcctgt catccaggta ctgggcatta
257101 tactcaacag ttagtttttc aacacttatt gcattccttc cctgcatagt
257151 attccacggt tcatatgtaa ccaatctatc cctgatggac acataggttg
257201 attccacatc tttgctattg tgactagcac tatgatgaac atatgagtgc
257251 atgtatcttt ttggtagaac aatttctttt ggatatacac ccaataatgg
257301 gattgctggt caaatggtag ttctgagttt tttgagaaac cttcaaactg
257351 atttccacag tggctgaact aatttacact cccaccaacc gtgtgtaagt
257401 gttcccttta ctctgcagcc ttgcccacat ctgttgtttt ttgacttttt
257451 agtaagagcc attctgactg gcgtgagatg atgtctcatt atggttttga
257501 tttgcatttc tctgatgatt agtgatgtgg aacattttt catctgttta
257551 ttggccactt gttcttttga gaagtgtctg ttgatgtctt ttgaccactt
257601 tttaatgggt ttttttttt ttttttttg cttgttgaat taacttcctt
257651 atagattctg gatattagac ctttgtcaga tgcatagttt gcaaatattt
257701 tctcctattc tgcaggttat ctgtttgctc tgttaatagt ttctcttact
257751 gtgcagaagc tctttagttt aattaggtcc tacttgtcaa cttttgtttt
257801 tgttgcaatt gcttttgaag acttagtcat aaattctttc ccaaggctga
257851 tgtccagaat gttcctaga tttttccta ggattcttac tgtttgagtt
257901 cttacattta aatctttaat ccatcttgaa ttgattttg tatgtggtgt
257951 aaggtagaag tccagttttg tatgtggtgt aaggtagaag cccagtctta
```

FIG. 5 CONT'D

```
258001  tacacatggc  tagccagtta  tcccagcacc  atttattgaa  taggaagttc
258051  tttctccatt  gcttcctttt  gtcaattttg  ttgaccagat  ggctgtgggt
258101  gtacagctta  atttctgggc  tctctattct  gctccattgg  cctatatgtc
258151  tgttttttgta ccagtaccat  gctttttttgg ttactgtagc  ctcaaagtat
258201  aatttgaaac  aagctacaca  ttcagtagca  ctgaatgtgt  agcttgtttt
258251  gggcagtatg  gcgattctaa  tgatattgat  tcttccaatc  catgagcatg
258301  gagtgttttt  ccatttgttt  gtgtcatcaa  tgatttcttt  cagcagtgtc
258351  ttgtagttct  tgtagagatc  tttcacttcc  ttggttagag  gtattcctag
258401  gcagtgtgtg  tgtgtgtgtg  tgtgtgtgtg  tgtgtgtgtg  tgtgtgtatg
258451  gctatcgtaa  acaggactgc  attcttgatt  tggctctctg  ctccaacatt
258501  attggtatag  aaacgctact  gattttttgta cagagtttgt  atcctgaaac
258551  ttactgaagt  tatcagttcc  aagagccttt  ggtggagtct  tagggtttt
258601  ctaggtatac  aatcagatca  tcagccaaga  gagatagtct  gacttctttt
258651  cctatgtgga  tgccttttgt  ttctcttgcc  tgattgctct  ggctagaact
258701  tcctacgtat  ctcatgtctg  agctcttatt  tctgaattta  tgtggttctt
258751  tcaaagattt  catcttttcc  ttaaattctc  ttagcttact  ctgaaatatt
258801  tagattgtca  ttttcatctg  ctttgtggcc  acatttttgg  ggtatgtttt
258851  cataatctcg  tgcaatgttt  tatggcttat  tttgatgatt  ttcttataat
258901  gatttagtgt  atatatatat  atatatatat  attccctttt  cccatatatt
258951  tatataacta  tatactaaaa  ggaggttccc  ggctaggtac  agtggcttat
259001  gcctataatg  ctagcacttc  gggaagccaa  agcaggagga  tcactggagt
259051  ccaggagttt  gagaccagcc  tgggcaacat  agcaagatgc  catctctcca
259101  aaaaattagc  caggcatggt  ggcacatatc  tatagtccca  gctactcttg
259151  aggctgagga  gggaggttca  cttgagcctg  ggggtcaag   gctgcagtaa
259201  gctgtgatca  tgccactgta  ttccagcctg  ggcaacatag  cgagatccca
259251  tctctaaaga  aaataaaaag  gaggttccta  tgttacactg  tatggacatg
259301  ctggagttta  aaaaaatcta  tttcctagtg  gaatctggtt  gtttccagtt
259351  ttggccatta  caaataaaat  cgctataaat  atttgcagag  cagccaatat
259401  aggttttcat  ttcactttttc atcagagaag  catacaatca  tcaaaggga
259451  aattaaaacc  acaatgagat  accccatcat  acctcatata  aaggctaaat
259501  attttaactg  ataatgccaa  gtgctgacaa  ggatgaaaaa  ctactggaac
259551  tctcttatct  tggtggtaaa  tttcaatcta  gagtgggctt  gccagatcat
259601  gtgataagga  tatgattaat  tttataataa  actgtcaaat  tgtcttctag
259651  gtggctgtac  tatttgcagt  ctcaccagca  agactaaggt  ttctccttgt
259701  tttgcatcct  tgccaggaaa  tgtattgttt  gttttgacat  tctgagtaag
259751  aggttgtgta  gtatctcact  gtggttttaa  tttgcatttt  tccaatgacg
259801  gtggtttttaa tttgcatttt  cccaatgact  attctatact  tctttcattt
259851  aacacaaaat  ggtaaccact  ttcctatgtc  attcaacagc  ctatgccact
259901  actctttgaa  aacgttcctt  ttaaaaggct  gaaaaatata  atgatgggat
259951  gtgtcataat  ttataaaacc  attcttctac  cattagatat  ttgttatttc
260001  caatttttca  caagaacaaa  attacactgt  gattataaag  ctttgattct
260051  atctctattt  ccttacaagt  ttcttagaaa  aggtcaaaag  gtatatgaac
260101  ttttgtttct  ccatgcattt  tgacaagcca  actggaagat  acaagtcaag
260151  tggaagatac  aagcatggaa  tcaagtaatt  aagaaaaatg  attctcaggc
260201  caggtgccgt  ggctcacacc  tgtaatccca  gcactttggg  aggtggaggc
260251  gggcagatca  tctaaagtca  ggagttcaag  accagcctgg  ccaacatggt
260301  gaaacccat   ctctactaaa  aatacaaaaa  ttagctgggc  gtgatggccg
260351  gtgtctgtag  tcccagctac  tcaggaggct  gaggcaggag  aatcgcttga
260401  accacggagg  cagagttgca  gtgagccgag  attgcaccat  tgcactccag
260451  cataggcgac  aagagactcc  atctcaaaaa  aaaaaaaaa   aaaaaaaaa
260501  aaaaaacat   caattatttt  gctgtttgtt  ttgttttttg  gtattcctga
260551  tgcgagatgt  ctttatcatg  tattgttgat  taggttgttc  atcagttaat
260601  cttgaataac  tgaaatctaa  gctgaaggca  ataatacatc  ggctttcttt
260651  tcatgcaagt  caaactgcta  aaatctacca  caaatatta   gcctttcatc
260701  agcttggtct  tcagatccaa  tacatttttcc cctcaaatga  aagacaatgc
260751  aatgccatcc  acaacaatgc  taaaaaaaa   aaaaaaaag   gaggagggaa
260801  acaaggttaa  gtcctgtctt  cttcctccta  ccccaaaaag  agctcagaaa
260851  ttaaggtgct  ttccctaaca  aagcctcctc  ctgctccatg  aagtgaccaa
```

```
260901 gcatgtcatg gcagacccag agatttataa tcttcaacat atcgttatcg
260951 gggaaatcaa gatttgacaa aattcttcct tcacgccccg tttctgcaag
261001 accaccactt tctagcttaa aataaagaaa aaaaaaagac agctgcagga
261051 atgcttggct gcccgctaat gtacaatttt gcccaaacgc agaacttgac
261101 gcccactatt accaaaggat ggccttagta aagtaacccc cgcgaagagc
261151 aaactgttta gcagccgctc cctcgaaaag gacggaagag gaggtctctt
261201 ctgaacctga ggatagtaga gaggcactcc ccttccacta ctagctttgc
261251 tcctttctca atcaggcagt tcatcagcta gcctcctttg tcaaaggggg
261301 ttgatggtca gaatctttgc gagacaaaaa ttactaaaag agctcccagg
261351 aaccaatgtt aaggcatcaa aggccccgcc cagcccccac aatgatcaac
261401 aaaccaaaac ctgggatccc tactattacc accaccacaa ccatcaccac
261451 caccaccacc accattcctc gctctctcta gccagggatg agactcaggc
261501 ccaggaaacc catcctttcc gcaagtagga aggcgctggg tctcctccct
261551 taggcctctc ctttacccca ttgttctctc cggacccctc cactacggcc
261601 aggcgctatg tatgttttca acccccaaga agcccagtcc cagccacaca
261651 caagatggca gcctcacacc taccggagga aacagctgcg ccaccactcc
261701 agtgatgccg gcctctcgac tacgagtaac tccattggct cagctacagt
261751 gcgcgagaca agccgagagc gctagcagtc aatcgggagg cggcgcgctc
261801 gggcgccact gcggtgccag cggtaagtgc gccgagtctc tgaggcgtga
261851 accagtgggg agtgcgacca atcaatgggc tcctggctgg gtggtgggac
261901 ggccggcgtc cgactcctcc catgtagtga tcggtttagg taggtcggcc
261951 tggtccccgg cggaggttac gccttccctc atccccggta gaggcagggc
262001 gggactgttg tggttgagat gaaggctagt aaatggtgaa gtacttcccg
262051 gccagagggc acctgcgctc gggaggtttg ggcggcttgg cgtcggagga
262101 gagccccacc cgcggaggaa cccagccttg ccaacggagc tggcggagct
262151 cactcctcag gtcaggcggg cggcgtagaa aacgcagcgg agccaggtga
262201 aaccaaggca ccgccgtggc tggcccccga cagttcctct agccgggagg
262251 ttggaggagc tgaaaacgcc gcggagccct cggccgcccg agcaggggct
262301 ggaccccagc ccttgcagcc tcccttctcc tggcacccaa gtgcagtcct
262351 ggctgcagaa ggggccgcgg gcgcactgag tttccaacct ccatttcagc
262401 ctgtctgtct cagggtgcag ccttaatgag aggtgattcc taagctgctg
262451 ggaacctgag gttgtcaaag gggcggcagg aaatggacag cagtataaaa
262501 cccagaagca gaacttgaag gttaaaccac tagcccattt cacaggtaag
262551 attacacgag cccttaaata cagcaagttc agtcattcat ccaagatcat
262601 ggagttcaga ttagatagta acacttctga ctcgctatca gccacagccc
262651 aataagtaat taagtaagga aagatatgta attaactgtg ctctttggca
262701 tgtggaaacc tgcagtgagc tctgtaaata ctaacacatg aggccaagga
262751 gaggagtaaa tttgaagagg tcaaatggag taaccaaagc ataggctctg
262801 aaaccatgct gcctggttcc ttatttcgtg tctgccactt acggtatggc
262851 attccttagc ttcctcatca gcaaacgagc tgctaattta acccacatga
262901 ctgttagggg gattaaataa gaacacgtga agtagttaga agcgtgacta
262951 acccgtggtt cttaagcgtg acttaacccg tggttctgtc gttacaatta
263001 aaacgtaagg agccgagagg aaatggtaaa cgtgttttta aagcctgttt
263051 tagaaacgaa aaggaaccat acattgaagc aaagcagact ggcttaatta
263101 ttttttctacc aaaatgaaaa agtgagaagg ggaaaaaagt tttttaagcc
263151 catttactct ctgaaatatt aacaccagtt gtctctggat gatgggatgg
263201 tgtttaaatt ttctcctttta tgctttattg tattttgcag attttctcca
263251 ggaaacatgt tttacttgtg cacgttcagt tttcaaattt tcaggtgtga
263301 acgctggtga gagctgctta aaaacaaagc tatgggccgg gcgcggtggc
263351 tcacacctgt aatcccaca ctttgggagg ctgaggcggg cggatcacct
263401 gaggtcagga gttcaagacc agcctggcca acgtggtgaa accccgtctc
263451 cactaaaaac acaaaaatta gccgggcgtg tggtggcggg ccctgtaat
263501 cccagcttct cgggaggctg aggcaggaga atcgcttgaa cccgggaggc
263551 agaggctgca gtgagccgag atcacgccac tgcacccttc tcactgcact
263601 ggtgacagag cgagactccg tctcaaaaaa aaaaaaaaaa tctatgccg
263651 tgcgcggtgg gtggctcaca tctataatcc cagcactttg gcagatcact
263701 tgagcccaga gttcaagacc aacctgggca acatagacct catgtctaaa
263751 aaaaaataaa actattactg agtgtgctta ggtggaagta taaattggta
```

```
263801 gaacctttct ggaagagagt ttgacaatat gctataaaaa gctttaaaat
263851 gaattccttt ttgaacattt atatatactt aatttttaaa aattaagtac
263901 acttttacat tcttttacag aattggtacc ttgtagataa agagcacaat
263951 ccagattttg accttgagtt ttttcttgcg tgtcaaggtt atacttataa
264001 aaacagttga atagcttccc gtattttttcc ttcttgaaag ttcgtatatg
264051 ataaaaattc tccgttcttt gaaagttttg tacaaggaat gttccctcac
264101 tcctctccct ccctactccc gctggagact ttggtacaga gctttcaagt
264151 gttttttaat acttacacct tttaatactg ttacatattc tatataggtg
264201 aatatataca tttgtaattt tttagtggaa aaatactata ctacatcatt
264251 ctgtagcttt atttcttgac attgttttg cagcctgtac atgttattta
264301 tagctcatta tgttatttat ggatcatttc ttttacctgc tgcatagtgt
264351 tccagtgtat gactgaattg atctgttaat ataaaacatt tctttgtctc
264401 ttttattggt cttgttgtta aatcctattt tgtttgatgt gtgctgtata
264451 gcacatttta ttgccattct ctgagaacat taggtttcca gttttcacc
264501 atacaacaat gctgcaagga aaatctttgt gttttcttgt gcacatgtgc
264551 tatttctcta ggatatatac ctaaaagtgg aattgcttgg ttttaagttg
264601 tgagcatttt tagttttaat aggtcatgct aaatttgcct ccaaaaatac
264651 ctctactaat ttacatgttc cacaggtagt ttatgagagt taagtttctc
264701 tacagtttag actaacatga gatattatct tcttcatttt tgcctagtga
264751 tggctgcaaa ttatattttt aattttaatt ttcattctgt gatctaagat
264801 tgaagtgtct attatgtttg ttaacctata atttatatgc atttctatag
264851 tttttttaaaa acatgtttaa gttctttatg tgtcctcgat actgtatttt
264901 tagaagtctc tttggtgtgt atggttaatt atgcctcctt tttgttgcta
264951 ttgttaaaat atgttaaaaa catttctct tagcttcttg cttggctttt
265001 gacttttgt taacttattt gttctacaga tggatttcc tctgccaatc
265051 tttaggcctc ttttatctt actgaatttc tctaagactt ccagtacagt
265101 attgaataaa aacagtgata gcaactgtct tcatcttgtg cctaataaaa
265151 attctccgaa tgtttcatca ttgagtatga tgtttgctgt cattgagtag
265201 gatgttttgg tagatagcct cgatcagaat aagaaagttc tctttttttcc
265251 taatttgcta aggggccccc ccaccttcca tggaataatt ttatattgaa
265301 ttgttttgtt tttctgcatg aagtgatagt tttcctccct ttgcctgtta
265351 atataagcat tcacattgat aaacttttca tgttaaactt tttaggtatt
265401 cttgggataa actatttgg taatacattc ttattctact gctggatacc
265451 tttattcagt attttttgtgt ctaagaccca gtagtgattt gggccttgag
265501 ttttttttctt gcatgtcaag gttatactta tctcataaaa aaaagttgag
265551 tagcttccca tattttttcct gcttcagaac agtttgtata tgataaaaat
265601 tagccgttct ctgaaagttt tgtacaattc atctgtaaaa gtttatggac
265651 ctagtgtact agcagtgaaa aaaatttcat atctcataaa aaaaaattga
265701 gtaactgctt aagaaaaagt tgagtagctt cccatatttt tcctgcttca
265751 gaacaggttt gtgtttgata aaaattatct attctttgaa agttttgtac
265801 aattcatctg taaaacttaa tggacctagt gaactagcag tgaggggtgg
265851 ggatgtgtgg cacacatctc tagtaatatc ttcagtgttt tgagcctatt
265901 tggtaattta tattttccta gaaaattgtt cagttcgtct gtgctcaggt
265951 tcattgacat aaaactgtct gaattttaaa atgtttaaaa tctcttcagt
266001 agctagagat ctatcttcat ttgttattat ttattttgtt gctttttcc
266051 cagcttcttt aattgaatgt ttaagtcaat attttcattt tgctaataaa
266101 atttatttaa ggcctaaata tctcttggca tgctgctttg gcaaaatcct
266151 tcaggctttg aaatgtatta cttcaaccga tcaccatttc taaatgttct
266201 taaatttctc ctttgatttc ttctgtaaac catatacatt atttgggaaa
266251 tttgattttt taatttccgc aggtagtatg gggtggggg ttgatttact
266301 acattcagtg actatgctct gtgtaaacag tcttttggaa tttgttgata
266351 attcctttg gtctcataat agttttgta aatttcatgc ttttcctccc
266401 acaagaagta ttttctgttg ggtgcagggt tctatatatt ttttggatta
266451 agcttgttaa tttgtcattt aaatccttta tactctggtt ttttacccac
266501 tttatctcag ttccttagat ttgttacttc atcaccaaat tgtggatctg
266551 tgcatttttcc ttttaatttt gctttatata tttcagagtg atgttatttg
266601 tacataaagg gtcatgaata ttaaatctgg tgaattgttc tgtcagcata
266651 aaatatttgt gtcttttatt gatttcata ttcaactctt atttgatacg
```

```
266701 tttcttctta taattgcaga tgtctttttc cagtctcttc gttttcagcc
266751 ttgctgtgac attttgtgta atttaagtgg gtctcttatt ttaaaatatc
266801 atatctgggt tttgcttgcc atccaatctg agagtctgcc ctttaatagg
266851 taattcacct ttattgtgat tattgacata ttttggcctt attcttgtca
266901 ttatttaaca agcttctctt tgtatctttt atatcttatt tttccacctg
266951 tttttttggaa cagagtcttg ctctgttgcc caggctggag tacagtggcg
267001 tgatctcggc tcactgcaac ctctgcctcc caggttcaag caattttcct
267051 ccctcagcct cccaagtagc ccagattaca ggtacacacc accacaccca
267101 gctaattttt gtattttggg tagagatggg atttcgccat gttggccagg
267151 ctggtcttga actcctgacc tcaggtgatc cacccacctc agcctcccaa
267201 agcgctggca tcacttttat ttttaattga ggttagcccc aagtttctt
267251 tgttcatttt tttttaagtt gattaacttt acatttcaca gttcttaaat
267301 ttatgttttc ttaacaaagt gtacatttag tcagttttga taaggcccct
267351 gtaaagaaga agttagcatg cttctacttt gcttctctc atcttgaaac
267401 aatcccttcc atctctcctc cagaaaagaa cataatctct catgatatct
267451 ttaagaattt ttctttcatt tgttattaaa ttcagtttac atttaacatt
267501 aatgtgtttt actcatttat ttgctcacta ttgctacgta tacctcagtg
267551 ctttcttata ggttcatttt tcatcatcag atacttattt ctttcacagt
267601 ctctgagtga ctctttgaat gtctgcaaat gtctttttt catctttagt
267651 atggaaagat agcttggctg gatatagagt tctgggttca tactgacttt
267701 gctttaacat tttgcatctg acatttctga tgagaaatct cattactagt
267751 ctaatacacc ttcctttag ataatctaca tttttctgga aacatctaag
267801 actttgtgtt tttgatattc tgaagttagt cacggtttgt ctagcgatgt
267851 gtgttaagaa ttttatcctg gttggtactc agtggattca gtttgcttat
267901 gtgtttttcca gttctgagaa attcttgctc attattgcct cctctccatt
267951 ttctcaattt tttgcctcct cttgtttcct tgctctgtgt tcttggtgaa
268001 ttactcaact cagtcttcca gcttactaac tggctcttca tgttagtctg
268051 ttctgtcatt cagtcatcta ttgagtttat ttcaacaact gttttatat
268101 ccaagatagc taactggctt ttttttcaaaa ttgtgtgtta tttcatggat
268151 gagatttcct tctttagctc agtctctttc atagtgtagc cttcttcaga
268201 tatttgagga ctctcagttg tgcattaatc tcctctgaga ggattcctgc
268251 ccatcgtttt gctgttgtga ttgtggttgc catcatctct atagcttccc
268301 atctgtttcc tttccccaga agggccttac tgacttggcc cttagagagt
268351 tcccttttg ttttcagcat ggctatatat atatatttta aatctcctaa
268401 catttccatg gtttggtgtg gaagtggcag aagaatttac agtatcttga
268451 ctaacatctt gagaattaaa attgttgatc tattttgac ctattattct
268501 acctccagat atgttatcct agggaaattg ccagagatat gtataaagta
268551 tatttatttt agcattattt attatactaa aaattaatct ataaggaaa
268601 acaatctaaa tatcgaatat agaggtttat attattaatt aatatttta
268651 ttaaaattta attattaaaa tatttaatgt actataatgt atgcgttatt
268701 gaccaaagta tgttatacag ccagttgtat tatacaaaaa tattagtgat
268751 ggaggaaaat gcaggaaatg ttttaatga aagattataa aaaattaaat
268801 atactacaat ccaaattttt gttttaaaac tacattctga aagaataaca
268851 ataattggta gtattccttg aatctttcgt atgtcaggca cattatatgt
268901 aattaagtct tgtcctcaga acaacctgtg agatagttag tattatcccc
268951 ttttttaaaag gtttataaaa gacttataaa atggagatag taatataaat
269001 acaaatatat taaatatggg tgataggatt gggtgggcct tctctattat
269051 ttctaatttt gatactttac atattttttc cagataacat aatgttttt
269101 tgtaatggtt catgctgttt taaaagatca agctgttata acaatatctt
269151 atttccttat atatacatat atatatatat atatatatat atatgtggtc
269201 cttacaaat atgcactatt cttttattgtt ttccttacag aatgtttcat
269251 ccatttgtgg accaaaagat ggagttggtt tttattttta aaagataat
269301 gttaatgatc tgataccact acaaatattt acgtgagaag attcatggac
269351 ttgtcttttg gttggactgt cactcatttc tgaaagtttc ttcagccaca
269401 atttctattt gaaaattcaa gtatcaaagg ataccaggtt tagaatggta
269451 taatgatgta ttttgtctga ggactgcaaa ttttatagag accacagttg
269501 gattccagtg atattctgca atcaaagtga tttgataaac ctaattttga
269551 agcattttat atttataagc gacatcaaaa gatgggagaa aaaaatggta
```

FIG. 5 CONT'D

```
269601 ggttgaagaa cacactgtta cactttatat ctaaaagtat aaaagtatat
269651 agacaatgta agctgatgtg gaattgtcaa ggttttgcat tgcgaggaac
269701 ttttctgaat tagagggaat taagggttta ttcttgtata gccaccaatt
269751 ttgactgtct ttatcattag ttgtgaaaaa attgactttt ttgtaaactt
269801 tttttttttt cttttttttt ggtgatggag tctctgtcgc ccaggctgta
269851 gtgcagtagc acaatcttgg ctcactgcaa cctctgcctc ctgggatcaa
269901 gcgattctcc tgccacagcc tcctgagtag ctgggattac aggcatgtgc
269951 caccatgccc agctaatttt ttgtattttt agtagagatg gggtttcacc
270001 atgttggtca ggctggtctc aaactcctga cctcatgatc tgtccacctt
270051 ggcctcccaa agtgctagga ttacagcact tgcacctggc caaaataggt
270101 gagccactgc acctggccaa aatacttttg tgttacagaa aaattgaga
270151 ggattgcaga gttccagtaa acctggtact tagctttatc tatgattaac
270201 attttacatt tggatgctac atttgttaca attaatgaac caatattggc
270251 acattattat taactgaagt ccatagtata ttcacgttag tttttacctg
270301 atgtcttttt ccattccaag atcccatcca ggacaccaca ttccatttac
270351 ttgtcatgtc tgcttaggct cctcctagct gtgatagttt ctgagacttt
270401 tcttgttttt tatttttttg ggattttgta tccaaatatt ttgtaagatg
270451 cccctctgtt ggaattattg tctgatgttt ttccataatt tgactggagc
270501 gatgggtttt ggggagtgtg atctcagagg taaaatgtca ttttcatcac
270551 atcatatcaa gggtacatgc tgtcagcatg atttctcaga gttgatattg
270601 aacttgatca acagagcttg agctggctaa tgtaggtggt ggtatcaaat
270651 ttctccactg taaagttact ctttttctcc cattccctgc tatactcttc
270701 ggaaataaat cactataggt agcccacagt taaggagtgg ggatttatgc
270751 tcccctcct taaatgtgga atatctacgt taattatatt tggaatattt
270801 ctgcagggga gatttatctc tctctcttct tccctgttta tttattcagt
270851 taatcattta tatcagcatg gactcatggc tatttatttt atacttttg
270901 agttacaagc cagtactact ttatttattt tgttttcaa attgtcccgg
270951 gtttggctat tgggagctct ttcagttggc tctttttttt cttttttttt
271001 ttaagatggc gtctcactct gttgcccagg ttcatgtgca gcagcgcaat
271051 cttggctcac tgcaacctct gcctcctggg ttcaagcaat tctcttgcct
271101 cagcctcctg agtagctagg attacaggtg tgtgccgcca cgcccagcta
271151 attttttgtat ttttagtaga gatgggggtt tcaccatatt ggccaggctg
271201 gtctcgaact cctgacctca agtgatccac ccgccttagc ctcccaaagc
271251 gctgggatta caggcatgaa ccaccatgtc ctgctcagtt ggctcttgtg
271301 tcccttttgat ataccgtcat cagtgtaggt attttttatt tgtctttgtt
271351 ttatagcact tccctttgg cactcgaaga ttgctctaga ttgctctcgt
271401 atatttctta cgcatcttag agtgagccat ttcttgaata acctgtcaat
271451 attttttattg gaaaatggta ttagaaacca aggtctgaat gataggtgta
271501 tttgttgtta ctggagtgtc cttgtttata ggccctttca gctggcagag
271551 caatgaagta tatatatata tactaactta tatatacaca actcatggct
271601 ataaatattt ctatatgtaa ctgtttgtat ctgccttaag ctaaccatga
271651 aattacgctg atgttccaa ctctaatcta ttaccacgtg gatcatttta
271701 gtctcctcac cttatctgta tgctcccact ccagtagtaa aaaacttagt
271751 tcccatcacc caccatccat ttacttaatt gttcaattcc agtatatata
271801 tgtagcagta tcagaattgt taacccttga ctgggcaccg tggcttatac
271851 ctataatccc agcactttga aaggccgagg ccaggagtta gaccagcctg
271901 gtaaacatgg caaaatcctg tctctactta aaaaaaaata ataatagtaa
271951 tacaaagtgg cacacgccta tatgtaatcc cagctattcc agaggctggg
272001 gcatgataat tgcttgaacc caggaggcag atgttgcagt gagctgagat
272051 tgtgccactg tattgcagcc tgggtgacaa agcaagacta tctcaaaata
272101 aataaataaa taaaaataga atttttaaccc atccccaggt aggaaaatac
272151 tttatcaact agagtacagt aagtaagtaa gtatatgcag ttacttttgc
272201 ctttattttt acagactcca ctcatttcca aagttactta ggtcagtacc
272251 ttttccaccc agcccttggt gaagttgttt atacatttgt aatacagtta
272301 gattctcttc atagtctgca ttccttactg agatccctga cgtcctaaat
272351 gatttttaaa atttgcatac gttattagtt cattgtttac tctttaaatt
272401 ctgtgggttt ttacaactgc ataatgtcat gcatctataa ttatagtatc
272451 atacacaata gtttcggtgc ctttaacata gttgtaatgt atggattgtt
```

```
272501 atacagatca tagtactgat ttcaccaggc tgtgatctaa gccagtggtt
272551 ctcaattttt tttttggtct caggatgact ttatactctt tagagtattt
272601 aaaaccgcaa agagcttttg tttatgtggg taacatctgt tgatacttac
272651 tgtaatagaa attgaaacta agaagtttca aaaaatatta attggcttat
272701 ttttaagaaa ataataaatc caacatgttg aaaatataaa tagaaactat
272751 tttctaaagc aaaaatatta gtgagaagga taacattgtc ttaccttgtt
272801 agaaatatct ttaataactg gcttattaga ttcttatatc tgcttctaca
272851 ttcagtcttc tgtgttatat tactttggtt gaactgaata aaagacaagc
272901 ttcacacaga caggaagctg aagaaggaag agtatttcaa tagcctttca
272951 tctaattgtg gatattttc tttgttgact ccaaaactca acaggtagtc
273001 attccttaaa ggttagttgg agtgtggagt ctgacatatc attgagtatt
273051 tttacaatgt tacattaaaa tccattggtc tatcttgcac tttgagtaga
273101 tctttttacca tgtatgattt tacatgtatt gaccacttgt aaaatattgg
273151 ctcagtgaat tatgcagatc ttccaaatgt tgacacattt aatcatataa
273201 ttttaaaatc acatttgtta atatagctac tgatctcatt ttaaaagtgg
273251 ttaactcttc agaaactttc aggtttgcca tggcagatac aaggttttca
273301 aaattctcat tttcattctg tagcttgaat tttgtcatta gcaagaaata
273351 ttgttagttt tgtccttcaa gtgataggct cactttgctc atatgccaaa
273401 cactcaagtc tggaaaacta cagttttatc agtggttctt ttaagtaaaa
273451 atggttttca tttaaaaaaa aacaaaaaaa aactagatag tttagtttac
273501 aagttgaaca atcccactag tattttttct tgagacagcc attgtactat
273551 aatggctgta caaatgattg taataactta tgttgtttca ttaaaggtgt
273601 acttagatga aattggtggt gaagatcaca atagtaagtg aactatcact
273651 tactgatagt ttgatgccac taacttgatt catgctaagt cactagcagt
273701 tttactcacc agtgcctttg tactatcagt tgtcaatata ataaaaacag
273751 caaatgtcct aatattattt tttaaatagt ttgtccttgt gtattctctg
273801 aaatgatttg gggagtccta ggggtccaca gaccacattt tgctaattac
273851 aggttcaaag ataccttaga gttcctctag accaataccc tataagcccc
273901 ttactacata tgtttctgtg tactgaggtc attattaatg tatttggtaa
273951 gtatttcata aatacttggc tagcaaatga attcagatca gtattattca
274001 tgagcattgt ctgtttacaa agactgtcta gagtgagatt ggtagacata
274051 gtataactat accatgtact tggcgtcctt cattacaagg ctgctacact
274101 tcttgcctca tggttatagt cttgcaatga atagtcataa ctggctaaat
274151 aaaaaagaga gtttgaacag ataataaagt taccagatgg tattcttcat
274201 ttctggggc aaatagcagc aatattagta tgctgaattg atcttcaatt
274251 caggtacctg ctccagtatt ccttgtaaat atcttctagt aaaatatacc
274301 gaaatattta gttttaggtt ataatgctga gcatgcatac aatgccgaaa
274351 gaagtgaaga tcaggagcaa gaaactaaaa ttgtttgtat tgtagtaact
274401 atgtctacag tcgaaaccaa agtctcccag atgtttcttg tgatactcat
274451 ttagtctcct tgtgcacaga agttgttaac tggatctatt agtttcattt
274501 atcagaaagt ttggttacct ctttcttat tactgtggtt aagggcttcc
274551 atagcaagaa gacaaagaaa aatgatcaag aaggaagaca tgaggaacaa
274601 gtgccatttt aatgaaaatt aaacctagca atatgagata ataaggaagt
274651 cataaggaac aacatattta tttaaaaccc agaacaaata aatatgaatt
274701 gcttagttac attcatttat tgtagaagca gattcagtat tttctttgat
274751 tggctttgtg ttttaaatt atattaccag tgtcctttt tttttcaaaa
274801 tcatttccaa gattgatcat ttactctgtt tactttttaa ataactcatt
274851 ttaagtagtt cctaccagaa taatttagta gcatgtattg gcatttctaa
274901 gactttttt tttttttga aagagtctcg ctctgtgttt tattaatcgg
274951 ttccaagatt gagcatttac tctgtttact ttttaaatga ctcatttaa
275001 gtatttccta ccagaataat ttagtagcat gtgttggcat ttctaagact
275051 ttttttttt aataactcat tttaagtatt tcctaccaaa taatttagta
275101 gcatgtattg gcatttctaa gacttttttt tttttttt tgaaagagtc
275151 tgctctgtt acccaggctg gagtgcagtg gcgcaatctc aacccactgt
275201 aacctccgcc tcctaggttc aagcaattct catgcctcag cctcccgagt
275251 agctgggacc acatgcgtgt gccaccacgc ccagctaact ttttgtgtt
275301 tttggtagag atggggtttc accgtgttgg ccaggcatgt ctcaaactcc
275351 tggcctcaag tgatctgcct gcctcagccc ccatgaggt gtggtggcac
```

FIG. 5 CONT'D

```
275401 cacacctagc ctctaaaaca attttaaatg ataaaaaaaa caaaaattca
275451 ttgagtcttg attgttgtct ttcagcatca cagctttttt ttcctcagtc
275501 caggacaaaa ttttatgtga ttccagaata ctttaatgtt accaaaagct
275551 atttttaaat acttccaaaa tacttgaaaa tacttcaaaa tacatctcaa
275601 tgtccacctc taataaagat aaatccctag taagaggtat tgactcatat
275651 ctgtgaaggg aaacttaaca ataatctatg aagtgctttg aaaaataatt
275701 ttgcctaaaa gtggtttttg ttgattatca gtgaaaaacc taatgatttc
275751 aggcaccctg agaaagccct gcttcacaaa atattttcct cattaagctg
275801 attgttctct aaaattccac agtgaaagat gaattccttt tgttcactgc
275851 agcctcgaac tcctgggctc aagcaatcct ctcgcctcag cctcctgagt
275901 agctcggact acaggcatgt accacctcgc ctggctgatt ttttgtaga
275951 gaggaggtct tgctatgtta cccaggctgg tcttgaactt ggcctcaagt
276001 gattctcctg tctcggtctc ctaaagtgct gggattacag gcctgagata
276051 ctgtgcccag tttgttattt ccattttata gatgtggtca cacagttaat
276101 aaatgggtca gaactagtat tcaaacccaa ctacacttga actccaaagc
276151 ctaggttgtt aatcaccact cttttctttt ccttggcttc tgagatacta
276201 ctctcctggg tttctcttcc acctcagtct ctatagttcc ttttccttgt
276251 attgttgatg ttctacataa gacccttctt attctgtatg ttctccctat
276301 ggaattacat ctactctatg gcatcagcaa gtatttgtac gttaatgact
276351 ccaatttgta tttctgaacc agatcttact ctagagccta tgcatccagt
276401 ttgttcggag agcctcttac tacttgaatt tgccacctgt ccctctacct
276451 ttattcatac cttaatgaat agcattattg tccatatgat tgcctgaggc
276501 aaaaaagtgg agatcattca tgactcctcc cactgctacc tgagtgatct
276551 ttctggaaaa cataactaat cacatcataa gatccttata cctcttgggt
276601 agctttccat ataaaggtg cttagcatgg cataggggc cttcgatgtc
276651 atgccctacc tgcctttttaa gcaccagttc tcatccattt tgtcctctta
276701 cattgctctt gtttaaaatc ttgaaatttt gtttgagctg tgctatgggg
276751 aattaaaagt aagcttagtc ttacatagta tacatcagtc cagagtatta
276801 gtagtaaaac aacaccctc cagaggccac tatgttggca gcagcactaa
276851 ctagccagaa gtcccctttg ggaaaggtga ctttcccagc aggaattgag
276901 actttgatac ctaagcccct tatgcagatt ctcccttctt tgccaaactt
276951 ggaggttctg ggtttaattt gtgttaggga aatgtatttt ttgtaagcc
277001 atctggactg tctactcatt aatcctccct gtgcctactc cagtgaccttt
277051 tctaaaatgc aattattacg atgtctttcc tttgcttata ggccctatta
277101 gttaatttta aataatttta tacattgtaa cattgtataa atatgcttag
277151 cattttaggt attttttgtta cttttaaacg cgaagtgaga tttagctttt
277201 gacaacttat aattgttttt cttatatttt caattttgaa aggattgttt
277251 ctttaggaaa attttgaagt attagcttac tgggcatcag aaatgttggc
277301 tcatttatgt aactttctct gtacaacttt aaacattaat ttgcttcatg
277351 caattaaaca tatagaagac tttttttaaaa agcagtattg ttggacattt
277401 agttatttca gcagccattg agttgtctca ttctgaaacc acactcggtg
277451 gagattatac cactgagact ttttaaagtg catgtataat ctatacatat
277501 accccacaac cactctccag tgaagtcttc cttctgtttt ctagtcaaga
277551 aagtgtcact aaaattttca atatatattt taaaaattaa cagaaatggg
277601 taagatactt agatcatatt gtttctagct ctttgtaagg aaacattact
277651 aaaatatttt cctcaaggaa aatgatagac cagatgagtc ttgatcttgt
277701 ttagaaacca agtagattgt tctataacat gttcttagat aaattatagt
277751 attttctat tagctcttag gctagtcact tatttttatt ttaggcgatg
277801 caaaaacttt ctggatggag ctagaagatg atggaaaagt ggacttcatt
277851 tttgaacaag tacaaaatgt gctgcagtca ctgaaacaaa agatcaaaga
277901 tgggtctgcc accaataaag gtatgaagca ataaaaactt gaatatgtt
277951 taatactaaa tatttctctc tgacagtaca gtatcattct atttccaata
278001 ttgctgtttg taaaagtaga tggatgtaat tacttttgaa taatacctac
278051 tgaatttctt tttatctcaa gctactttt tccctcattt atcttttttt
278101 ttagggaat gttgcaaaag taacatctgc tcattatata acatttggca
278151 cttatagaaa aatataacaa ggaaaaatta ttccacattc agagacaact
278201 agtttttca tatgtatgtg taaaagtaca tataacttta ttttgcctgc
278251 tttaaacaga acttactcta ccagtcttct gaaagcaaaa tttgtgttct
```

FIG. 5 CONT'D

```
278301 acataggcag ttagttcagt aatccaagtt tttatttttt ctatttgttt
278351 gttgtcaacc ctggttggtt gtagaacgta agacttgaag atgaaatcct
278401 ccttcaatcc atcaggacat acggttttga agcaaatttt tctccagatt
278451 atttttagta ctttctggat ggtcttatga cattattatt atgtgtttat
278501 caaaaaaaat tggcactgtt tttcatttta atcttccttg tcaatccttc
278551 atgagtcaga taaatctaga ttctaatcca gttgtactac ttcttagctg
278601 aatgtcctgg aataaatagc ttaacctctg agcctcagtt tcttttgtct
278651 ctaatgcaga tagtcctatt aacctctcag aggaatagtg aagattaaat
278701 gagataaaat atgtaaattg tttagcacag tagctggcac cataaataaa
278751 ggtaatggtg atgctgtttt tctgtcttta acagaataca tccaagcaat
278801 gattctagtg aatgaagcaa ctataattaa cagttcaaca tcaataaagg
278851 gtatgtacat ctctattccc attgtagagt attctctgat atttcttgc
278901 catgaagcag gatagcttta atatgttggg ctaattaaag ataatttaaa
278951 ataaaatcta acatccacat ttctaagtta cataaatcac agtttcctct
279001 gttaaatgaa aagtcctacc catctagaga tagtaaatgc acatccaact
279051 aagcagccta gggaaagaat taacaaatgt gtgtcgtctt tgggggaaaa
279101 aaagactttc ttatataaag agggcaaata gaattctaac tttaaaacac
279151 tatatatccg ctttctgtga agaacaatac ttgaaagata tattcttgta
279201 tagataagtt ggtgggtaaa tctttattt ctagattgct tttagaccat
279251 cagtcttcca agctctaaat cagcttagaa ggatcaaaga taatgtacta
279301 aagaaaaact gtttctcttc tcacaaagct tctgacacca aatgtgggtt
279351 ttccatgcca tgcaattctc cagtattctg tggacaccaa tggatgttgt
279401 attctaaaat ttaattcagt tctgacacta ctacccagag ttagcacaga
279451 tcccacagat taagggctca ttcccaccaa cttgctccca cttcagacac
279501 tggtcacaat gcctgggcct cctgtacttc tgactgactg ctacaaatta
279551 gaggttccca caacccctc ctcagattcc atgatttgct ataatggctt
279601 atagaactca cagaagtatt tactattacc agtttattat aaaggatatt
279651 ataaaggata caaatgaata gccagatgaa gaggtacaaa gggcaaagtt
279701 gggaagggcc tgagaacagg agcttctgtc cctgtggagt tttggggtgt
279751 accaccctcc cagtatgtag atacattcac cagtctgaaa gctctctgaa
279801 ccctgttgtt caggggtttt gtggaggtct cattacatag gcatgattca
279851 gtcatcagcc cattggtgat ttgcttaatc tgcctcttc tcttccctgg
279901 atatggggt ggaaagagta gggatgaaag tgcgaactca ttaaccatgc
279951 ctttgtcaga agtgccttgg tctttctgac aaccagcccc cattctgaag
280001 ctgtctaggg atagctcacc tctcaacagt catctcatta gcatacaaaa
280051 gacactctta tcactactgg agattccaag ggtctcagaa gttcttatgt
280101 caggaactgg ggattaagac aaatattata acagaaggtg ctcctctcat
280151 acctgttact tgaaattaga agggttttag gaattaggtc aggagccagg
280201 gcagaaacca aatatgtatt tcttatgatg ttacatgtac taagacttta
280251 aaaagaaaaa ctgagaagtt attttaacag gatcaatcac cattccataa
280301 atcttagtct gtcacatttg ctgaagtttt aaggaagtac aatatttact
280351 aggtttgtat taatgctgtt agatgttgtc aataaatgtc aataattttt
280401 gtcttttata atttggagcc ttaaggcttt taaatctctg aaaatatagt
280451 ctagcatcac cagtctattt taagtaaacc atttggtatt caaagtatcc
280501 tcaatttcag tgctacagta tagctttaga agagtagttt cttgaagaaa
280551 acagtcttcc tttcacagta tccttcagta cactcggaa ttgtagggga
280601 ggaaaaattt tatctcagtg gctggggat gagggctgta acaaaagata
280651 gaagacaggt taacaggaga agagacataa acaaatgtgt taattttttt
280701 ttcttttttct tgagacgaaa tcttgctctc tctcccaggc tggagtacag
280751 tggtggtatc tcagctcact gcaacctccc cctcccaggt tcaagcaatt
280801 ctcctgcccc agcctcccga gtagctggga ctacgggcgc atgccgccac
280851 acccggtgat tttttttttt tgtatttag tagagagagg gtttcaccat
280901 gttgcccaga ctggtcacga actcctgagc tcaggcaaac tgcctgcctc
280951 ggcctcccaa agtgctggga ttacaggcgt gagccaccgc gcctggtcaa
281001 cttttaattt tatatgcaca agtgttgcgg gaattaggag gaccagagag
281051 accttcgggt gaatacagga ggatctttat tgagtgcact cagacccagc
281101 agacttaaca tccaaaaact tgggccagaa caaagacagc acttgacttt
281151 tatacacaag ggggtgggct agcctgaaac aagcttacag tggcatgaag
```

```
281201  cgtagtggca tgaaagggta cagaggcaga acaaagacag ttaatcaaat
281251  tgtgacaggt tcataactca gcattacacg tttgctatgc agcccagatg
281301  tctgttatct aggttttct ctagtgccta gcacagctta ttccatgacc
281351  ttcactgtgg tgcccaggtg gccataattc aggcctgctc agatggctca
281401  tgaccttcac tccaccactg cttagataaa acagaatact tgaagttact
281451  agttacagag aacaggaatc tatacactca taccataaga gaaaggaaaa
281501  tttgttttc tcctctctat gttgagggag tgctgggaga gtcccagagc
281551  acattccttt gtgtcctggc ttcttagata gtattaacaa gacttttct
281601  gggtctggc tgtgcctatt gctgcctctg ggataagtca tcctaataca
281651  ggaaagctta tttctctttt taattttatt tttctttctt taattccctg
281701  cctcacagga gcatcacaga aagaagtgaa tgcccaaagc agtggtgaga
281751  tttgagagca cattatacca ccctaatagg tgaaagggag gagcagaggg
281801  gcacttctgg aagaacacat gacttcaaag ataaatgggt cctatgagaa
281851  taagtgaaag atttgtaaca gtgtctgtct gagtatagta ctgacttcct
281901  ctgctctccc tgattagatg aaatcattcc tggttgatga aacttctggg
281951  aggggattta tgacaattga gtttcttttt gggaggatcg atttttagac
282001  agataaggga actccagaga caacttcttc ctgtatttgt tcattctcag
282051  atgtcttcaa ttcaaaataa tctttatgtt actatatctc atctggacaa
282101  tccttaaggg attatattta gttttgcaag agagaggctt ttaacctcac
282151  ttgttaccaa gaaaaatggt aacaactaat tctaaacatt tcttttcttt
282201  ctgaagaacc ttttttttccg taaaaagtaa gttggttttt gtttggggtc
282251  ttttaaggaa ataattttat caatagaaat gccgaatatt ataatttcat
282301  atttttatgt agttggtcca tctgaaatgt aacaaatgca tcaagataag
282351  agtatattta tttgctagca gtgaagtgtt tttaagtaaa cagttgggga
282401  gagttatgta actgacactg ttggcaaatg taaggattga aaacctttgg
282451  taataaaggt tcatgtgggc tgaatacagt ggctcaggcc tgtaatccaa
282501  gcactttagg aggctgaggt gggaggatca cctgagccca ggagtttgag
282551  accaacctgg gcaacacagt gagacctcat ctctacagat aataaaaaaa
282601  aaaattagtt ggctgtggtg gtgtgtgcct gtgattccag gtactcaaga
282651  ggctgcagtg ggaggatcgc tcgagcccag gaaatcaagt ctgcagtgag
282701  ctgggatcac actactgtac tccaaccttc cagcctaggc aagagagtga
282751  gaccctgtct aaaaaaaaaa aaaagtttca cgctagcatt tatttttaaaa
282801  agaaggttgg gaatgagaga aacaaaagaa ctttgtgttg aggtcaaaac
282851  aagctgtcct ggatccaacc tagactcccc aggctgtcat caaaccgcta
282901  attatgttta ttttttcttga tgttgtgtaa ctctcagtat ttgctctgtc
282951  tccatatgaa ggactggata gtgttttctt gagagaaatt atttccctttt
283001  cctctttttt ctaatgacta atgttaaatc ctcatgtttt tgagtaaatc
283051  ctatttccaa ctatgcttga tatacatttg ttttgttcat atttgttaat
283101  atagatttat ataactcatg caaataaatt agctggagga aaagtcagaa
283151  actcttatta tttgtaaaat taatttctaa tcagttatag ctgtgaacca
283201  aaaataatca aaagggtcag aatctaattt ttttttttt tgagacgaag
283251  tctcactctt atccccaggg ctggagtaca atggcacgat ctttgctcac
283301  tacaacttcc gcctcccggg ttcaagcgat tctcctgcct cagcctctcg
283351  agtagctggg attataggca cctgccacca cacctggcta attttgtgt
283401  ttttagtgga gacagggttt cactatgttg gccaggatgg tctcaaactc
283451  ctaacctcag gtgatccacc cgccttggcc tcccaaagtg ctaggattac
283501  aggtgtgagc cactgcgccc catccagaat ctaatttaaa gagagtttat
283551  tcaggtgcaa agtgtaaggg tagccatctg aggaccagtg ctacaccaaa
283601  gaatactgat aagtgcttct ggtgtgggag aaatgaggat tatttatata
283651  ggcaaaacag aggtgttgaa caggattaca gcattttgt acaaagggta
283701  acatacagat atttgattgg ctactgttga ttacactcta agtgggttgt
283751  ccaacattct gttgtaaaca ggtaacagtc acaagggtct ctttctccat
283801  atcatttaga ctaggtttga ataaagaata gggagtcttg actgggcgtg
283851  gtgtctcagg cctataatcc cagaaccttg gaaggctgag gtggcaggat
283901  cacttgagtc caggagttca agaccagcca ggcttgaggt agagattcta
283951  cctctacaaa agaattttaa aaatcagtca ggtgtggagt tgcacacctg
284001  tagttctagc tactctggag gctgaagtgg aagggtagct tgagcctagg
284051  agttcaaggt cacagtgagc ttatgatcac atcaacgtac tccagcctgg
```

284101 gtgacagagc aagaccttgt gtctttaaaa aaaaaaaaaa aatgtggagt
284151 ctagttaatg tgtaacatct caacacagaa gtcagaaagc aatggtcatg
284201 caccaaagaa aaaacaatca tgttacatga gtcctctttc agggcttaac
284251 ttttcccttt ggcataataa atttggaagg tcctaaattt ttattttctt
284301 tttacatagc tctcttcaac tatcagactt ttatttattc atttatttta
284351 gagagagggt cttcctctgt cgctcaggct ggagtgcagt ggtgcaagta
284401 tagctcacta cagcctacgg ttcctgggct taagcagtgt ttccacctca
284451 gttcctaaat agctagaact acaggcatgc gccaccatgc ctggctaact
284501 tttttttttt ttttttttc tgtcgtagag acagggcctt gttctgttgc
284551 tcaggggggc cttaaactcc tggcctcaag taatcttccc actttatcct
284601 tccaaagtga tgggattaca gggatgaacc ttgtgcttgg ctcagctatc
284651 agattttaaa cctttcttta cttggaaaat taaagacaga tatttgtttt
284701 tcagttagcc aaggagcaac cttgaaatac aatatccttt tattaaactt
284751 cttttgaggg ggaaagtaag ttataatttt tttattagaa aataaatata
284801 ctgggccagg catggtggct catacctgta atcccagccc tttgggaggc
284851 ccaggtgcac ggatcacttg aggtcaggag ttcgagatca gcctggccaa
284901 cataaaatcc tgtctctact aaaactacaa aaattagccc agcatggttt
284951 tgcatgcctg taatcccaac tactggagag gctgcggcag gagaatcgtt
285001 tgaacctagg aggtagaggt tgcagtgagc caagatcata ccactgcact
285051 ccaccctggg cgacagagtg aatgagactc tgtctcaaaa aaaaagaaat
285101 gtgaacaact agatcaaaag agatacccag atacttcatc ccctccctaa
285151 aatagttgta gagcaatagg aaaacaaaag gtacataaat ttttcatttt
285201 ctgactttta tagagccttt aagaattatg tgatttctct ataaaatgca
285251 tgcagaagta gggatactca atgtccacct taaagattgg ttaagcttca
285301 aatcaagttc aggccaaact agagtttcta cagtagaaat cttttctgtc
285351 ctcagtattt tatcctagtt tattcatatt tttgaaaata ttgacactta
285401 atcttttgcc tcaatcttga aaccttacta tgtttgcaaa ttttagggat
285451 ccatatgggc agactctagt caatgaacat attacttggg tacttatagc
285501 aaatggtttt taacttggta tatttgttgc tcacattatt tttttgtgta
285551 gatcctatgc ctgtgactca gaaggaacag gaaaacaaat ccaatgcatt
285601 tccctctaca tcatgtgaaa actcctttcc agaagactgt acatttctgt
285651 atgtatataa attctttgtt attaatgctt ttgctcctac agatttcttc
285701 tttataaatc acttgacatt agaatagatg aaatatacaa aaaaattttt
285751 cccattaaag ctttaaaagt tgtatatttt agtatttat gtaagataga
285801 atttcatgag tctctgaata ggttattgaa tattcctagt taatcaagtc
285851 tttttataaa gtttagctta agatgtcttt gtgtatttta ttaatacact
285901 gaaatctacc aagtagtgtg ttttgtttt gttttgtttt ttgttttact
285951 gcttagatta tctggagaat ttaaaagtgt caaaatgttt ctttcagtat
286001 cagttgagtt ttcaaaatgc gtaacagctc ttaagtagtg tctaaaagtt
286051 tatgggaata gactaaattt ttctgacctt cccttctca ttttatcatt
286101 actttccata aagattcttt ggcataaagg agatgtgcgg aagagtgaat
286151 ctagatactc tgacacgtag tctttatttt tagtaggtaa tacctgggcc
286201 taacccttca agtactaatt acagggaagt ttctgaaagt tctctagagt
286251 agagaacata gtttcaaaaa acaaagaagt atctttagaa agaaacttct
286301 ttgttaccct aatttcattt gttctttcag cttaatatta aattgactaa
286351 gaaaaactat ataattattt ttttgatttt catgcctgtg agagttgtag
286401 atagacactg tttcatataa tttggattta caaatattag agatgtcatt
286451 gcagtttgag tgggtctcaa aaggcccata aaattacttt aaaatgctca
286501 cagagaaagc taagttcaca ctttagctcc ttaattggcc atttcagtgg
286551 ctcacaaaac attttttttt ctagaaattc tgacctttga atatacagtg
286601 taaaattttg taagttttta ggaacaaatt cactcagtct aaatctaaat
286651 taaattttca tgtaaattac caccaaacaa gctctctacc aaacagttat
286701 ctatatattt agatattata ttttaaactt aaatgcagga gtggtttatt
286751 cctgtgaagt atcatttttt gctttaagtt cattataccca gcttatcaga
286801 atcttttga attttggaat attttttgtc ccttttagct tatcatcttg
286851 tacaaataaa taagctttct aatcttcatt atggtcactg aaaacaatat
286901 tgaacaggac atgaccaaag ataaaaacct tgtggctggc tcactactag
286951 acattctttt tattacgctt cagaaagaac gctttaagca actgtgaatt

FIG. 5 CONT'D

```
287001  tacttctact gttgtcccgc ctacacttct cacttacaaa gtggtcatga
287051  aaaatcaagg ttcactgcca tagcattctg tggcattgcc agacattatt
287101  cagacttatt gaaaacgttg tcaaaaaga aaattcagtt aatttggatt
287151  tttctcacct acttgttaac tcagcaccta gtgttggttg gccttttaaa
287201  ttcaaaatat ttagaagcca cacccttgat gccttcttct agagattttt
287251  aagagaccag tgttaagcta acctttctat attttctgta gcctgtcctc
287301  cttcccttt taaaaatcag ggcagctaga acttgaggat aagtggtcaa
287351  agaaaaaatc agggcagtat tattttattt ttaattttc tatatttgaa
287401  gttttttttt ccagaccttg agatttaatt tgtagagtct tctatatgct
287451  taaataaact tgagttctag taccctctct ttaactgtca cagacttcag
287501  tttcttttta ttttttttcct cttgtttcca acttgagagc catacttaaa
287551  gatggaaaag acaaaggcag aattgttttt gagaaactct tccttctctt
287601  tgttatcagt taaccttatt tttctcctaa cagattattt tcttgttcta
287651  agcatagctt tagttgtttt ttgttgttgt tatttatta gcacttttgg
287701  aaacctcggt tcttactagg ctttgtgata cttttcttac agtttcgtac
287751  caatgttgcg tattcataat tagctgtctt cttttgtatg tatacttta
287801  aaaatccgag cttccaagaa aaattgagtt ggtttcttta actgttttcc
287851  catctctta ggactgttta tgattatata atcagaattt catttccta
287901  atctcccatc tctcttgtac tgtgttgaca ctcagaggct tttttgaga
287951  ttatacctaa cttttgagtt gagcattctg atcttttc agatgaaggg
288001  acatgtctta ttaggcttag gattttcttc ctttgccatt aagaattcca
288051  aggaagcatt tcattcttga ctggaattat gtttaaataa ttccttttat
288101  atttcctctg caggccagaa gtttatttgc ttattttatt ttcagtactt
288151  aaaccctctt agcagcccag tggtcacata ggttgcctag taaactaaac
288201  attcaataac ttaagccagg aattcttagc cccagctaaa ctgctcaaga
288251  ttaggctgag catggtggct cacacctgta atcccagcac ttcgggaggt
288301  tgaggcagga ggatcacttg agcccaaaat ttcaagacta gcctgggcaa
288351  catggcaaaa ccccatctct acaaaaagta acaaaaatta gccgggcttg
288401  gtggcacatg cctgtggtcc cagctacttg ggaggctgag gtgtatcacc
288451  taagtccaga agatcaaggc tgcagcaagc catgatcgcg cctccgcact
288501  ctagcttggg tgacagagtg agaccctatt tcaaaaaaag attatacaaa
288551  ctatcaacgg caaaccccag gatgaaatct tgggtctaat aggacacagg
288601  cttcaggctt ttggtgtttt tttgtgggt ttttttgttt tctttctttc
288651  tttctttttt ttttttttt ttgagacagc agggtctcac tgtctcgctg
288701  ggtggactgc agtggcacat agccacagct cactgtaggc ttgacgccct
288751  aagctcaagc gatccttcct cctcagactc tcaagtagct aggactacag
288801  gtgcatacca ccacacctgg ctaattttta acattttttt ttttgtagc
288851  gatgtggtct cactatgttg cccaggcagg tcgtgaactc ctagtctcaa
288901  gcagtcctcc ctcctcagct tcccaaagtg ctgggattac aggcatgagc
288951  caccacaccc agccagtatt ctattcttga gttgaactga atttctactc
289001  cacataagtg agttatgaca taggtaaatg taaaaacaaa agtattactt
289051  cagtgataat tcttttaaaa ggatatttac ttttgtgatt ttagaagtct
289101  gaattccctt ttttttttt ttttggtca agtataaact ttggtttgtc
289151  aggagtacat acctattcaa gctagcttaa gtagtggaat ttattagaag
289201  tgtacgaggt gtgcagcttt ggttagcata ctgggtgaca ctgggcttgc
289251  accactgctt aaagacacag gtgtaaattt aagccattaa atttttatgg
289301  cttttacat gacatgcaca caaacccaaa agattatttt taaaaacatg
289351  cacacacatg tacctacaca tacatacaca catatataaa taaaataggt
289401  cttgaagaac agaaaatgta acacagcagg ccatgtaaac actaaaatag
289451  gaacttaaaa gtcaatacct aaggtcaggg ttgacacagt ctcaactcta
289501  cttctctctg ttaccagtag gtttcttctc ttcccacatg accaaacata
289551  gctgccccag ctaaactcta accttctagt gcaagtgtta tctcatgtga
289601  catatatata tatatatata tattttttt tttttaaaa tagagacagg
289651  gtctagtcat gttgcccagg ctgatcttga tctcctgggc tcaatgaatc
289701  ctcccacctc ggcctgccac agtgctggga ttacaggcat gagccaccgc
289751  acccaaccat tttttttaat atcttaattt aaattattga aagagacagt
289801  ataaaaagcc cagtatgtat acaagaccca acatctttga gtacactgaa
289851  attaatatac ctgcctttca gaagaggatg actaaagaag ggactgagca
```

FIG. 5 CONT'D

```
289901 aaataccaga tttacctact gcagtctttta gatgaataca gtatacattc
289951 ttgttttaaa atatgccccc ttaatggtca tagaggatag aatgacttct
290001 tactttagcc ttgccaaaag ctagataatc agttggcagc ctctaagcca
290051 tgctccactt tgatgttcag agtgactaac aacaccctga acaattgtca
290101 aatcatatgc aaactgagaa atccttaccc agaggctggc aagcaggtcc
290151 agacagccgt ggacttctcc ttctcactac ttactcctta tcctgtgttt
290201 acctctagca cttttaatca atgactgggt ttacaatact gtgcatagaa
290251 ttggttttat ttctattttt tttttcagta atgtatcttc acacctaaat
290301 aaagttaacc ctcctctcca taaaattggg atgaaattag gttactttat
290351 acttaagact tgtaagttgg gttttttcct tctctttagt aaaatgaagc
290401 acagataaga aattaatctt ttctaaggtt cacactagtg ttttatttt
290451 atgcttttct cctcctcttc tgttttttc tcttctcctc ccactcctcc
290501 ctaactcttc ttaaatgtaa aacatgtatt tctcagtgtt aattgctcag
290551 taactagagt cttgtatctc ctagttttta ttagtcataa ggagaatact
290601 tttaatctag tttggctttc ttgaaatgta aattccaaat tacaagtttt
290651 accagcatat ttactattac aaattttagt cctaagtagt tctaattgta
290701 tattgttcca gtagtggcta acttggagtt gtatttgttg tgtcatatga
290751 ggaaattatg taaaggacat taaactacta ttcaaatatt agtagttact
290801 taagaactaa ggataaccca gatacttct ctctcacata tatcctgaat
290851 taatccctc atattccaag aaaaatttat tgagtcatct acattaatat
290901 ttaatgttcc ccttcctcca aagagcaaaa caggaaccaa aaaattcata
290951 cccgaggcca ggtgcggtgg ctcatgcttg taatcctagt actttgggag
291001 gccaaggcag gcagatcact tgagctcagg agtttgaggc tagcctgggc
291051 aacatggtga gaccccatct ctaccaaaaa agcaaaaaat tagctgggct
291101 ttgtgacgca tgcctttcgt cccagctact cgagaggctg aggtgggagg
291151 attgcatgag cccaggaggc agatgttgtg gggaaccaag attgcaccac
291201 tgcactccag cctgggtgac agagtaagac cctgtctcca aaaaaaaaa
291251 aaaaaaaaaa attcataggc aaaatgtcaa atgacattta cagaataata
291301 tactacagaa tccagtttga aacatattta tttggttaag tcaagttgaa
291351 aaggacaaca gaacagttta ctatctctat aaatctgtaa gtgtataagt
291401 aacttgagag tgagtaacct atatcaaaac aaagaacaag gccatgagaa
291451 cctaaggaat gtattacagt gaattctgaa tgaaagaaaa tagggtgttt
291501 tatctcagag agacaaataa atagaaaatc cagagttcag gttataccat
291551 aattccttat aagaaaaagt ggtaagaagg aacttgacac ctaataatag
291601 ggaacaagta ggttccaggt accacctttg aaaaacagga agatactgga
291651 tactaaaata aatcaaggc caggcatggt ggctcacacc tataacccca
291701 gcactttggg aggccgaggt gggtggatca cttgaggtca agagtttgag
291751 accagcctgg cccacatggc aaaaccctgt ctgtactaaa aatacaaaaa
291801 ttagctggat gtggtggcac atgcctgtaa tcccagctac ttgggaggct
291851 aaggcacaag aattgcttga agctgggaag cagaggttgc agtgagctga
291901 ggtcatgcca ctgcactcca gcctgggcaa tagattgaaa ctcactctct
291951 ctcaaaaaaa aaagattct aaataaatta tagtatatcc ttttacctgt
292001 tagactctga aatccaaaag catcaagatc cacctgattg atgaaactct
292051 gtgaaaacag gcactctcat ttattgctga agaaactgac actatggaga
292101 acaatttggc aatattaatg aaataactaa cccatttgcc ttgtgaccta
292151 gcactccac ttctgggaat atgttctgca acagtatcta acagtatctt
292201 tacgtgtatg aaattgttat taatagattc ataatttat agcaaagatt
292251 attacaataa aattacttat taaaagatca ctgtataagt ttactgtata
292301 cgttctaaaa gatcactgtg taagttaact agtccattat tgtggtctag
292351 cctatactac atgttatgga aaattgtcca ttattgcagg ctaggtaatt
292401 aaattgtgga cttacgcaaa ggattactat acagtcggag aaaggatgag
292451 gaagctccat atctgcacat ccagtatggt agccactagc tgcatgtggc
292501 tgtttaaatc tgaattaatc aaaattagat aaaatgtaaa aattcagttc
292551 tttggtcgtg ctagctacat ttaaaagtgc tcagtaacca catgtgccca
292601 ctggctacca tatcggacac cacaggtata gaccatttct atcaatggag
292651 gaagtttttt tggatggcac tgctttatat agtgtattag tccgttttca
292701 cgctgctgat aaagacatac ccaagaccag gcaatttaca aaagaaggag
292751 gtttaatgga cttaccagtt ccacatggct ggagaggcct cacactcatg
```

FIG. 5 CONT'D

```
292801 gcagaaggca agcaagagca agtcacatct tacatagatg gtgacaggca
292851 aagagcttgt gcagggaaac tcccccttac gttaccatca gatctcgtga
292901 gacttattca ctatcacgag aacagcacgg gaaagacctg cacccatgat
292951 tcaattacct cccaccaggt ccctcccaca acacgtcgga attcaagatg
293001 agatttgggt agggacacag ccaaaccata tcatagagca aatacaacgc
293051 atctctaaaa tacctgtatt ataatacata acagacacct aaagatagaa
293101 aattctatgt aaaacaaaac tcagattatt tgtgaaagtt taaaacttga
293151 tttccaaaca aaaggaagct tttcacggat ttttttttt ttaagacagg
293201 atctcactct gtcacccagg ctggagtgca atggtgtgat catgattcac
293251 tgtagcctca acctccgag tccaagtgat catcccacct cagcccccga
293301 agtagctgga actacaggca tgcaccacca taccttacta atttttttta
293351 cttttgtag ggatgaggtt tcactgtgtt gcccaggctg atcttgagct
293401 cctgagctca agcagtcctt ccgtcttggc ctctcaaagt gctgggatta
293451 cagttgtgag ccatcacacc ctgccgactt tttttttat tttattaata
293501 accacccat tttctcctat cagtttgcca tttttcaga tgtatcaata
293551 tgattgtgag gtagattaca tattatggaa agaattaagt tggtactatt
293601 gttgaaggca aacagtataa aggattcttg atgaattaat aagttttcag
293651 ccagcctttg ttttttgca tgcaaagagc ttgatctcag catgcctgaa
293701 gaagtaacct tcttcagtgc tttattgatt catgctctaa atgaactcta
293751 aatttgctag gtgctatgaa atacctaaca gaaagttaca gctgtaatca
293801 caacttcctg gaatattctg aaattaggta taaggcagac ctggtgcgtg
293851 cctataccag ctatttggga agctgaggca ggaggatcac ttggggacaa
293901 gagttcaagg ctgctctgtg ctgtgatcac acctgtgaat ggccactgca
293951 ctccagcctg ggcaacatag gaagaccca tctccgagaa aagttttaaa
294001 aatagatata atctttgtat ggctgtagaa catcttaaaa tgtgtatctt
294051 agagtctggc ttattttaat attgtctaag aaggtagaaa ataatcatag
294101 tttttttaaa atgaggaatt gaactataaa tttgagatac taatgaataa
294151 tttatttaa cagaacaaca gaaaataagg aaattctctc tcttgaagat
294201 aaagttgtag actttagaga aaaagactca tcttcgaatt tatcttacca
294251 aagtcatgac tgctctggtg cttgtctgat gaaaatgcca ctgaacttga
294301 agggagaaaa ccctctgcag ctgccaatca aatgtcactt ccaaagacga
294351 catgcaaaga caaactctca ttcttcagca ctccacgtga gttataaaac
294401 cccttgtgga aggagtctac gaaacgtgga ggaagttttt cgttacctgc
294451 ttgagacaga gtgtaacttt ttatttacag ataactttc tttcaatacc
294501 tatgttcagt tggctcggaa ttacccaaag caaaagaag ttgtttctga
294551 tgtggatatt agcaatggag tggaatcagt gcccatttct ttctgtaatg
294601 aaattgacag tagaaagctc ccacagttta agtacagaaa gactgtgtgg
294651 cctcgagcat ataatctaac caactttcc agcatgttta ctgattcctg
294701 tgactgctct gagggctgca tagacatgtg agtagaaaaa catggcgttt
294751 caaaaaatc ttctgaatgt aaggacgctt gttaagaagt cttgctatgt
294801 attaatttgt ctatctaaaa cctgttcaag agttacagta agactgggcg
294851 tggtggccca cgtgtgtaat cccagcactt tgggagacc gagtgggagg
294901 ccagcttgag caaaggagtt tgagaacagc ctgggcaaca tggcaaaacc
294951 ccatcttaac aaaaaattta aaattagct gggtatggtg tgtgcatct
295001 atagtcccag ctactctgga ggctggggtg ggagatctgc ttgagcccag
295051 gaggtcaagg atgcagtgag ctgtgatcac acactgtacc agaggcctgg
295101 acaacaaagc aagaccctgt ctccaaaaaa taaaataaa aataaaagag
295151 tctacaatgg gaaatgaac tctgtcacta gcagtaggaa aaaaaacctc
295201 taattatttg ccaaatatgg taatttgaaa catttcttcc aagaatgcat
295251 atttcctta atctagtact aatacattaa aagataatca atggcattac
295301 aacaaatgat atttaacagt gccagacact gtgacaagta cttcacattc
295351 attctcttaa tcttcacaaa acccatgag gtataggtaa tatctcagtg
295401 ttatacatga ggaagttgag cctcagagaa gtcaatttgg agaggtcata
295451 gaacaaattg tagagacagg atttgaaccc atgttcttaa ccattgggtt
295501 atatgttgca ttttacttt aaaatcatt tgctggctaa tgtgatgctt
295551 ataactagta tttcttaat catagaatag tattaacatc ccatgaaaaa
295601 atgaaaacat gttctaatat attaagactt tgaaaaacat tttaagggtg
295651 tgtagtacac atacattcgt aggtatacag atgtagagtg gtgttgcatt
```

```
295701 atatgtactt ttaatttaat gcaaatttag ctacccatac ttggcaaaaa
295751 aagaataaga gaatgataaa taatttaaat agtataataa tagttttcac
295801 catcctctaa gttaattgga gtgtaaaatg agagctatat ctactgttac
295851 ctcagtttgg ctcagttcct tgaggcctct catagaggaa acctctcact
295901 gtgctgtttt attctgttta aaaatatgta ttttattttg taaagattac
295951 ctctaaatgt aacccaacta cctcatctgg ggacttggct cttcaaagga
296001 atagaaacag gtacctgcac aagactagga actaggccag tatctcacag
296051 ggcctggaat tgtattaatg aaaaccttgt taacagctgt aaaaccaatg
296101 gggtcagagc caaagcgttg gagaaagcac ccaatgtaga gcagcacaca
296151 ggactaaacc ccacagaagg tatgatttca aacaaacatt tacagcacac
296201 aaagatgttt aggaccatga aggcagcatg agtcccgaca agtagagaga
296251 attaacacct gaggaatcag aggtaaatgt tgaatctaat tgaaagggat
296301 tttaaaacag gtataattaa actgtcccaa gaggctgggc acagtggctc
296351 atacctgtaa tcctagcact tgggaagct gaggtaggaa catcatttga
296401 gcccaggagt tcgagaccag cctgagcaac ctagcgaaac cccatctcta
296451 caaaaataca aaagttagcg tggcgtggtg ggacgccctt gtagtcccag
296501 ctagtcggga gtctgaggtg ggaggatcac ctgagtgcag ggaggtcgag
296551 gctgcagtga gccaagattg cgccactgca ctccagcctg ggcaacagag
296601 tgagacccct tctcaaaaaa gaaaaactat gaattgtata tgaagtgagc
296651 aatacctaat ccagtagaaa agttaaaagg aattaactag atttgtatat
296701 agcatggatg ggtctcaaaa acattatatt gaacaacaaa aaaagcaagt
296751 tatagaataa tacctatagt aaattttta taatgaaaaa tacacaatat
296801 attgtttgta gatacatgtg tatataaaag cataaaggat gccacactaa
296851 atctcttgag agtttagtta tatctatgtt ttacttttta actttttta
296901 agaagaccat atatatgtgg tgtatatgtg gtgtgtatat tttgaattat
296951 atatacaggg aagagaacta gacaaaatgc tgacaactaa ttctggatgg
297001 tggaaatatg ggtgttatt attatctgta ttttctgta cttttaaac
297051 tttgcacaca aaatcacatg ggaagaaca attatagatt tcatatctg
297101 taaacagaat ccaaattaat gaatttgttg attgttgtcg ttgttcttt
297151 ctcttgcaaa cagcagccac cattctgatg tgtattaatt aatacagaaa
297201 atacagaaga gaatcataga ggaaaagacc ttaaagtcac ttgttcagca
297251 aaggagacta agatccagag atttttaacca gctcaccagc agtcatttac
297301 ctagttacac agctagagtc cccaagttcc ttactttgta tcaaattatg
297351 gttccctatc aagttagtta gtcatctgaa tagaggggaa agtacatgaa
297401 gttttatggt tgcaagcttc ctgcctcgca acagtatgaa aaaaggattc
297451 aataatagta ggcagatacc cggcatcaat ctccccagtc tgtttctgtc
297501 actggagtga gagagaactt aagacatctg caaaactatg tccttacaaa
297551 tttgacatat ttaagtttat ccattgtaaa agagcagaac tagcagaatt
297601 ctcacaaaca agcttctgtg ctgaacaggg aaattaaagg aattgatttt
297651 ggaaagctaa actcatatag ttaagtattt catgagcaaa tagagttgca
297701 gtgcagtta taattattta taaactttg ggaggtattg tctttcaaag
297751 agatctattt agggaaaaag ctgatagtgt tcatgagcca aactattcta
297801 aatgctatta catctttat tacatcattt acacatttat caagacagtc
297851 tcttgacttg acttgctgct ttttcattct ttctccatcc attgcctgcc
297901 ttttagaaca aaatgtgcat gtcttcaact gacagcaagg aatgccaaaa
297951 cttcccccctt gtcaagtgac aaaataacca ctggatataa atataaaaga
298001 ctacagagac agattcctac tgggtaaggt accttgagga tttgttgcag
298051 ggtgtgtata tctttgaagg tgggtacttt ttattgtggt ccaaaatctt
298101 atagatgtta aatctggttt aatttggttc taataccaaa aatctaaatt
298151 attaaggaat aaaaatcctg tgtattgttc gtggaaatgg tagtcagaga
298201 ccacacatac atcatgcaga gtgtacttga acactcatct gctttgagtc
298251 tggctcttac ccctctagta tcagcctact tgggcagcc atttctccgt
298301 ttaaaaataa ctgtctagaa ctcatttgag aattgggaat tttcaacctt
298351 tcaaggtact gactcactta atcttcacaa agcagcccta tgagggaggt
298401 attgtcatat aatccccatt ttaaaaatgt gaagataaag cacagaaaag
298451 ttaaataact catccaagat aatacagcta gtaaatgtgg aagctgtgat
298501 gggaacccag gcactctacc tctaagagct ttcacattta gcctgcttcc
298551 ctcagtagtt atcagtgtca gtgaagtgtc aataaactgc tttttgagat
```

```
298601 gtctgatttt ctcttttgca tattttgttg acagcattta tgaatgcagc
298651 cttttgtgca aatgtaatcg acaattgtgt caaaaccgag ttgtccaaca
298701 tggtcctcaa gtgaggttac aggtgttcaa aactgagcag aagggatggg
298751 gtgtacgctg tctagatgac attgacagag ggacatttgt ttgcatttat
298801 tcaggtaaag caaaagttta ttttcaaatt attctagagt agaatccact
298851 tttctaaata tccatttttcc tagccagggc tgttgagagc ttacagcaag
298901 gtaaagagta acagtatcta agaggaacat cagagaaagg caggtaaact
298951 gggaacttga gcactaaaga gatgagatgc ttaggaggta ctttcttcaa
299001 gaaaagaaag gttcagagat gacacttggg tttttgtgtg agggcctgtt
299051 acgtacaagg cacatttgtt ttgtctgcat ggctacaggt actttggggt
299101 aagggaataa aacttgttaa aagtaaaaaa aaaaactaaa tgactggctt
299151 gccaaggtaa agatgaccag tcaaaaactt tcttattcaa tgttttgagc
299201 tattattaga atttaacaag ttaattatgt aatatctgca tgttataatt
299251 cagtcagtga ctttaggcaa ctcactctat tttggggact gcagagagtt
299301 gtccatgctg cagagcaaaa cttcccgagc agtgtgttac agtcatgcaa
299351 ttactgattc tttagggcca cagcccccag ggccaaacac atcagtcttc
299401 agtagtctta cacatttacc tccagcatgt caggcaaaat cccttatttt
299451 ctgtgcacat ccttctgtga gaaagtttgg gaaacacggc tttagagcca
299501 gtctaaagga attgtccttg acttatttta gcagttaggc atcagggaaa
299551 agaacaacca ggttctgaaa attactcatc tgaaaaatca ggtttaatct
299601 gtttacatga ccatgtgctt agaaaagaaa tatcaggttc acatcaggga
299651 gggcaagaag aagcttgcag agttcagagt agtcacacgt atggatccct
299701 gccactcccc atttacagat ccacattcta cacatcctgc ctagacgttc
299751 atctctcata cttctcaaaa taactcttgg atgaaagcta cctgtaaaat
299801 gccaggtggt gtccaggaag tatcattggt tttatcgttg ttgctggaaa
299851 atgtaactaa gatatgtctc cgatctaaca atgggtaaga atatcctgct
299901 attaatttgg acttggcaac tataatattg aatcccttga aagaaaatgc
299951 atgaacttta gaccaagatt ttagtgttat gcagaactta atatgacaac
300001 actaagaaca tatcaccaca tatttaaata ggtacttttg ttaaaaattt
300051 taagtttcag atgataacgc cttttaact agacataaaa gctacaattt
300101 tatggctaga gtcatctctc taattttcta gagtactttc tcatccatat
300151 cttttttgtat cattctagct aaatctcttc tcttttgtat tataccaaaa
300201 cagacaaatg gtttttttt agataccctg ttttttcata tactggaaga
300251 taagaaatat cacattggtc tttgtcttgc aacagttttg taggatgagt
300301 taatgtgttt atcttcattg tagaatgtgt gggttcttta gtcatggagt
300351 agaaatagag atgtctgttt atcattagca attatcttct gtgttgttca
300401 aactctttaa catttttcctt ttaggaagat tactaagcag agctaacact
300451 gaaaaatctt atggtattga tgaaaacggg agagatgaga atactatgaa
300501 aaatatattt tcaaaaaaga ggaaattaga agttgcatgt tcagattgtg
300551 aagttgaagt tctcccatta ggattggaaa cacatcctag aactgctaaa
300601 actgagaaat gtccaccaaa gttcagtaat aatcccaagg agcttactgt
300651 gtaagtaaca gctgaggaac ccagagtaaa tctaaattat tatcaatcaa
300701 ttggttcttt ttcattcctt ccctctttc ttttctcctc atttgtattt
300751 atcattttgc ttcaaagttg ttaagtctaa cactttgaga aatccaggac
300801 atgtaaaaat ctagccaata taccatcctc agtgttccag ttttggaatt
300851 ttaccttata tgacttagt caggtttttt atggatgtca taagttttgc
300901 tgttttttaa aatttctat cattttatct gcaaagtttt cataggttct
300951 cttccttttc caaatgtact tcaaaaatta tttatgatta tatttccttt
301001 ctctagggaa aggaataaac atagatgttc ttacttaggt taatttataa
301051 taattaagga tatttatgta ataatggata ttatctgtac ttgagtaaag
301101 agaatgaaga gaattttag tgatacagaa taacttttt ttcctttta
301151 gggaaacgaa atatgataat atttcaagaa ttcaatatca ttcagttatt
301201 agagatcctg aatccaagac agccattttt caacacaatg ggaaaaaaat
301251 ggtaaaaaat gcaaatgta gttgggaccc ttcttttctt tttaaattt
301301 tttttttttt ttttttttt ttttttttt ttttgacgca gagtctcact
301351 ctgtcaccca ggctggagtg tggtggcaca gtcacagctc actgcagcca
301401 caatctcctg ggctcgagta tcctcctccc tcagcctccc gaatggctgg
301451 gactacaggt gcacaccacc atgcccagct cttatttagt agagatgggg
```

FIG. 5 CONT'D

```
301501 tctcactata ttgcccaggc tggtctccaa ctcctgagct ctagcagctg
301551 ttgtgcctca gcctcccaaa gttctgggat tataggcatg agccaccgca
301601 cccagctgct ggggcccttc tgagatgtaa actattgcct tcctatcctt
301651 tacttagctc aaaatgtttg tgttacttta tagtgtgtag aatttctttt
301701 attgttttgg aatggtggac ggtggaaatg ctaggaccat gttctgttta
301751 cttagtatca tccacggcag ttgacatgtt tccagcttgg ctgtatgagg
301801 agaatgctgg tcatgatctg acagtgtgct ccactgagac cgagaggtat
301851 cccattctga gagtttgtgg gagaagctaa agtcttcagg agttaatagt
301901 gatatataag aaaagggaca aagtaattta ggtgaaggag aacaaggttt
301951 ttgttttttg ttttgttttg ttttgagatg gagtttcact cttgttgccc
302001 aggctggagt gcaatggcac gatctcagct tattgcaacc tctgcctcct
302051 gggttcaagc gattcccctg cttcagcctc atgagtagct gggattacag
302101 gtgcctgcca ccatgcccag ctacttttt gtattttag tagagacggg
302151 gtttcatgat gttggccagc tggtctcaaa ctcctgacct caggtgatcc
302201 acccactttg gcctcccgaa gtgctgggat tagaggcgtg agccactgcg
302251 cctggctgaa ggttttaaga tgtatgagaa agaagagatg caattttatg
302301 aaagaatcat ccagaaaaca gtatttatg tggtagcctc tgagggtacc
302351 ctttgcattg tgaactaaag attagtcaga gactgaaacg tagaagcaga
302401 gaaagagaaa agagaacaaa gagagacata atggtagctt actttagggc
302451 ttgttgatga agagtaaaaa ctctgcttta ggtgttatgc aaatatttgc
302501 cctctgcctg gtaatggtac agtagctacc tcttaaggt cagagaatta
302551 tgaaaagatt ggccatggtg tcacacagac ccaggtgtaa cctccagctc
302601 tgctgcgtgc tagctgggtg gtatctccat acatacattt cttttatctg
302651 taaaaaggta atagtatatg tttcagaatt atgaggatta aatgagataa
302701 gcatcagcaa cttgcttagc atccaactaa gtgctcaata catgttgacc
302751 attcacatgc tgagaacttt catagtaata atatggtcaa tgtgtattga
302801 atacttagtt ggttgccaag cattgtgctg agtatatacg cctcttttaa
302851 agttatcatt actacttaaa gtgactgcag tgtctacaat gtgtaagcat
302901 tatcacattc gttaaccttt ctttgaagta gaaactagcc aatgagtgtt
302951 tttcatcttt acacaactta cagttgaagg caaatttata atctagtaat
303001 aacactttct aagtactgag atgattagaa ttgggggata cagacaggga
303051 tgcattaaga tttttaattcc caaagaattt cttgacagtc tttatagctg
303101 tggcttaata aagcacctag aagtagaaca gagtcaaagg ggatgacact
303151 tgttgactcc attagtctaa agactcctta tgatatcagc tttgaggctt
303201 ttcaaaacga atctagtaca tatagcctat gatgattgac acttgatgaa
303251 agaggcctaa ctgctaaata cttttgcctg acctggaaag taaagacatc
303301 ttccttgttt ttttaaggaa tttgtttcct cggagtctgt cactccagaa
303351 gataatgatg gatttaaacc accccgagag catctgaact ctaaaaccaa
303401 gggagcacaa agtaggcttt gtttcttctg tgaatgccta cctcttctgc
303451 ctgtttctct gtctcttgct caatacctgt agctcatttt cttagattcc
303501 ataataaaca tgctgcattt gtcagaaagg ttacaacttg tctacataag
303551 agatcagcaa aatatcgtgt gtgggccaaa tctggccctc tacctgttca
303601 gtatggcatg tgagctaaga atgggatattta tgttttaaa tagttgaaaa
303651 aaatcagaag gtgataatat tttgacactt gaaaattata tgaaattaca
303701 attttagtgt ccagaaaataa agttttggcc aggtgcagta gctcacgccc
303751 gtaatcttag cactttggga agccaaggca ggagggctgc ttgaggctat
303801 gagtctgggc aatgtagcaa gatcttgtct caacaacaac aaaaatagcca
303851 ggtgtggtgg tgcacacctg aggtcttagc tactcagggg gctgaggtgg
303901 gaggattgtt gaggtcagga gtttgaggtt acagtgaact atgattgtgc
303951 cacggtactg cagcctgggc gatagaacaa gaccctgtct caaaaaaaaa
304001 aataaaatgt aagttttatt ggaatacagc caatttacat tatatattgt
304051 ctgcttcaac attacagcaa gagttgaata atcacaacag agaccaccac
304101 atggccagca aagcctgaaa tatttgctat tttgccttct gcaggagaac
304151 tttgctgacc tctggtctaa ttgccagtag tgacttgatg catgacaaga
304201 ggggtgggct ggaaaactct tgagtctttg tggtgcacag gtgttgtccg
304251 tggctttgga accattgtgc aaagcagcca cttcaaact ctttgtagac
304301 gcctttaaaa ataaacacac atcactttcc tgcaattgcc tagccaatac
304351 tgccgcagag catactcagc ttgactctgg caaaaggcta aaatattgcc
```

FIG. 5 CONT'D

```
304401 accctgagtc cttgtgtttc agagttacta gtccttgcca tagttaatat
304451 tacaactgga caaacattgt ttttggtact tttgcatttc actgtgtcct
304501 tcacaaggag acattgctga gagatatccg tttgtgaaga attggtgagc
304551 cactgctgtc tcttccccc tgcaaccgca gctctccacc taatattaaa
304601 ggatggagat tggaggagac atggcagttc cttgatagaa aaggtctatc
304651 aaaaaagggg attttgtgta ttatatttat tttatcatgc atgtgagcca
304701 cagtgcatac cgttgctttt ggttcttttg ccctttttcat tgactgctac
304751 aatatatata gcgggtactc caaaagtcaa aagctacata cttttttgtat
304801 aaaaaaatcc aaagttgtat tatggcttac acgtaaccca tgattaaaat
304851 ataagtacat ataggaacag cagccagcaa caacagtgat gattaaatca
304901 agagcctcaa ttttagacaa gtataattc tttgcgccat tgaattaggt
304951 ggtccaaata gctttgtggc tcttttaaag taagtaattt atacttactc
305001 catctgacat gcattcatat cttttcttt tttttaaag agagacagcg
305051 actcattctg tcacccaagc tggagtgcag tggtgggatc atagctcact
305101 gtaccttcca attcctgggc tcaaacagtc ctcccacctc agtctcctga
305151 gcaaacagga ctacaggcac accccctt gttggctaat ttcttttttt
305201 taaaatttt tgtagagatg gggtctcact ttgttgccca ggctggtctt
305251 gaattcctgg cctcaagcat cctcctgcct tggcctccca aagtgctggg
305301 attacaggca tgagccacca tgcccagcca tattcatact cttgaatact
305351 ctcaaaaaat tattttcctt attggataag aaaaacgatt aagcagtgca
305401 tctgctttta aaggattatt gtttacaaag gtgtaattat tgaatggtca
305451 tctagtaaaa caccaaacac taatatgtgc aaaaccccta gcaatacagt
305501 tgtcactgct gggacttgtg gaaggtgtct ctgtcagggt taggccttt
305551 attggcagca taaaggccta gagtgcctcc aaaacaccca ctctgttaca
305601 tttgtttaga atatacttaa gtgcagattc cagaattaaa gagaagaaag
305651 tcagtttatt atgagtagag attaaatata ataatgaaga agcaagatgt
305701 agattcataa aaaggcattg ttacgtagta gaaagaaggc agactttggg
305751 attcaaacat ttctaggttt gttaccccag ttctcgttat tgtgggtcag
305801 atgaattcct taatccctca gagaaagttt cctttataca attaaaataa
305851 tactacctgc ctaacacatt gtaaggatcg ataattaaag cacctagcat
305901 ctaattagtg ttgttaattt cagcactatt gctcagcaag tatatttcct
305951 gatgtttcct tccaaaatgt ctattagagg actcaagttc aaaccatgtt
306001 gatgagtttg aagataatct gctgattgaa tcagatgtga tagatataac
306051 taaatataga gaagaaactc caccaaggag cagatgtaac caggcgacca
306101 cattggataa tcagaatatt aaaaaggcaa ttgaggttca aattcagaaa
306151 ccccaagagg gacgatctac agcatgtcaa agacagcagg tattttgtga
306201 tgaagagttg ctaagtgaaa ccaagaatac ttcatctgat tctctaacaa
306251 agttcaataa agggaatgtg ttttattgg atgccacaaa agaaggaaat
306301 gtcggccgct tccttaatgt gagtataagg gctgagattc ctatttctga
306351 acaactgttt ttttctatgc tacttaacaa aattatgagg aaaataaaca
306401 gactctaaag tcagaccatc tggttagaat tccagtcctc cacttgtata
306451 cagttggatg ttttacttga cctctgatac ctcatttttct acctctgtaa
306501 tacagggata aatgataact gtctcaggat gttatgagaa tctaatgaat
306551 taacattaag tgcttagaac agtgcctagc acatagtaaa catttgcttt
306601 taaaaaactg taagaaatgg tgtataagaa aagtatttaa atatatcaga
306651 tttaaataag ctcacttacc tgagttgaaa aaaatgtatg gctaggaagt
306701 tatcagtgaa gttaaatggt ggcagatatg tccaaagaat actgcaggga
306751 tttaatggtg tattaatatg gaaagattgc cacaatatac tggttttttg
306801 gtttttattt tttgtttttt ttgagacaga gtctcacttt gtcaccagtg
306851 gcacaatctc agctcactgc aacctccgct tctggggttc aagcaattct
306901 catgcctcgg cctcctgagt agctgagatt acaggcgtta atgaatcaca
306951 tgatgaatgt gtggagatgg cggctagtgg gcaacagagc aatactggaa
307001 tagtgctaat atgaggaaat ggtatcatct atttagaagc ctcggaacga
307051 cgatacataa tggctatctt cagcaaagaa atttgttgct tacaatatct
307101 cctctccaaa aggcttgttt gttacagtga tgtaaaaatt aggttctgta
307151 catcttcata ttaaacttac tttgtgaaaa cttttttgttt aaaaaaaaaa
307201 aaaaaagcca taccttgaga agtactgtgc tcctgttccc atgccccgac
307251 tccaccttct ctctgtaggt catcatattt attctttttt ttttttttt
```

FIG. 5 CONT'D

```
307301  tttgagaccg  agtcttgctc  tgtcaccagg  ctggagtgca  gtggtgtgat
307351  ctcggcccac  tgcgatctcc  gcctcctagg  ttcaagcgat  tctcctcatc
307401  agcctcctga  gtagctgaga  ttacaggtgt  gcaccaccat  gcctggctaa
307451  tttttgcatt  tttagtagag  acacaatttc  accatgttgg  tcaggctggt
307501  cttgaactcc  tgacctcaag  tgatctgcct  gcctcgcctc  ccaaagtgct
307551  gggattacag  gtgtgagcca  ccgcacctgg  ccttatttct  cccgccccc
307601  ccccctttt  ttttcacat  aaaacatagc  atattatatt  cactgttcta
307651  tactttgttt  ttcaaattaa  cagtatattg  ggccaggcgt  gatgtgactc
307701  atgcctgtaa  tcccagcact  tgggaagcc  aaggcaggca  gatcacttga
307751  ggtcaggagt  ttgagaccag  cctggccaac  acggcaaaac  cccgtcacta
307801  ctaaaaatac  aaaaaaaatt  agccgtgtgt  catggcacat  gcctataatc
307851  ccagctactt  gggaggctga  ggcatgagaa  tcacttgaac  ccaggaggcg
307901  gaggttgcag  tgagccagga  tcatgccact  gcactccagc  ctgggcgaca
307951  gagtgagact  ccgtctcaaa  aaaaaaaaa  aaaaaaaaa  tcttgtggca
308001  attccatatt  aatacccaga  gcttctcaaa  ttgttttat  ttgtatgctt
308051  ttgtttatag  ctgcatagaa  ttctattgtg  taccaaagtt  tatttaacca
308101  atctgcttta  ggcaaatatt  tgggttattt  ccaaaccttt  agcactaaaa
308151  acaatgctca  atgaataatt  acacatggaa  acatatacag  atgaatctgt
308201  ggaatacaat  tctagatatg  agattgcaga  atcaaaagac  aaatgcattt
308251  ataataatga  taaatattga  catatttat  agggatttgt  cccatttttg
308301  catttctgcc  agcaacatag  aagagcgtca  gaacagggct  tttctgaatg
308351  ggttcccact  attaacagga  gctgtgataa  tttatacatt  gacaaaaaaa
308401  gaacaaaatc  agtgtgatat  attaaaaaca  gaatggtttt  ctaatgcaaa
308451  agcacaaggc  atcagacttt  atgctatttc  taacctttgt  gtttattttt
308501  atttaacagc  atagttgttg  cccaaatctc  ttggtacaga  atgtttttgt
308551  agaaacacac  aacaggaatt  ttccattggt  ggcattcttc  accaacaggt
308601  ttgaaattga  tttcgcttac  ttaattctga  aattgtgact  ttaaaaataa
308651  caatagaggg  ctgagtgctg  tggctcatac  ctgtaatccc  agcactttgg
308701  gaggccaagg  tggggagact  gcttgagctc  aggagtttaa  gaccagccag
308751  agccacatgg  cgaaaccctg  tcttactaa  aaaaaataga  aaaagttcac
308801  caggtttggt  ggccagctac  tcaggaagct  ggggtaggag  gatcacttga
308851  gcccaagagg  tagagtttgc  accctgtctc  aaaaaatgat  aattataata
308901  gaaaaatatt  tttaaagat  atatactata  gccccaaata  tctggtactg
308951  tagaatattc  aattatccta  aactgttcct  attcaataag  attttgcaca
309001  cctgaaattt  tgactcttat  tcccatttag  aatgaatgcc  tgaaagggct
309051  gaagatatca  ggtatcaccc  agttccactc  gggataaatg  atgcagagtg
309101  ctacataatc  tttaattcag  agctattccc  cagctacttc  cacactgcag
309151  gcctcaacac  atgactgggt  cccactgttg  gcaaaataca  cttcttcctc
309201  atattgatag  gttccttctt  acttaacatt  ttagtagatt  tgaaataaaa
309251  ctcaaatggt  tattcttaat  aaaaggtcat  tcctaattgg  tggatgttgg
309301  gtgagagaac  agatcatatt  tttgaggatg  gttaatgtta  atatgaaaat
309351  tgatataatt  tggttcattg  gtagttattt  agggtatttt  atgattcttt
309401  tcaaatttct  actttctagg  tatgtgaaag  caagaacaga  gctaacatgg
309451  gattatggct  atgaagctgg  gactgtgcct  gagaaggaaa  tcttctgcca
309501  atgtggggtt  aataaatgta  gaaaaaaat  attataaata  tgtaactaac
309551  gcctgtttgt  gaaattagct  tatcaggctg  aaattaaagc  catgcaaaag
309601  aaggtctagg  tccatcaagg  aaattcccct  ccgttttcct  ttgtcatggg
309651  gtttatgttt  tatttcagat  tttatttgtg  tgacttagaa  attccaggaa
309701  cacaattagg  atattttcat  acacatagg  tatcttgttc  actgctgtgc
309751  tactttacat  gagtaggatg  gaagtgtata  tttatatga  ataccactg
309801  tacaatttat  aatttattta  caattatat  attaagagaa  acaaatgtca
309851  taacagaact  cagctgtttc  taattgcttt  tgtgactgtt  accttttagt
309901  tcatgccccc  ccaaagagct  aaatttcaca  tttttaccta  caaaattgat
309951  ttttaattcc  tggcaaataa  tttaccatta  tgagctacaa  ggtgggcaac
310001  agcgcctgag  gatctaattt  tatgcatatt  actcccaagt  attttaacac
310051  ttgttggaga  agcaatatct  ggatcgataa  aacactgtcc  catcaaccat
310101  ttgagtgggg  agagggagaa  gctcttctgt  aagtaagatt  ctggcaagct
310151  ctttgaaatg  agtcttcttt  cccacagatt  ttctctactc  tttctataca
```

FIG. 5 CONT'D

```
310201 aacagatagg agaagaggga atagaaacct ggaggaactt gaatattttt
310251 gttctagata gagatacagt tactgaaaag gaaacctaga aagtagtcac
310301 acgttgctta tttaggccag aagtaattgt actgggcaaa aatttcactt
310351 aaaaaacaca agaagtccag gtatggtggc tcagacctgt aatcccagca
310401 ctttgagagg ccgaggcagg tggattactt gagcctaggg gttcaagacc
310451 agcttgggca acatgtcaaa accctgtctc tacaaaaaat acaaaaatta
310501 gcctggcatg atggcatgtg cccgtagtct cagctactca ggagtgaggt
310551 gggaggatca tttgagctca gaaggtcaag gctgcaatga gacataattt
310601 caccatagta cttccagcct gggcaataga gcaagactct ctctcaaaaa
310651 aaacagcaca cacacacaca cacgaaaaca attctgaact atgaaatctg
310701 aaacagcccc ttggtatctc ctgggcatga tttgcaaatc tttttttttt
310751 acagaaaaaa ggcaaagagt aagcactttg ccataggtta cttggccgtg
310801 atcatctatc tagtggaaaa ggggactggg aagcccaagc agactgggaa
310851 accagacagc taggaaaagg agcaaaacat agcccagcaa cctacagatg
310901 aagaaagttg agaaatccat ttattcacca tagagacgca ggaatttcag
310951 gcaatgcact aaaatgaaat gggggaaaaa agcttgatca gtatgggaac
311001 cattttgtg caaaagggaa tattatggat cagccagtat ttctttgagc
311051 tctgcctgtg gagtccattt gacctttaga aatatgaggt attctgtcag
311101 ttttatcttc ttggagaaat ttctcctaaa atcttgattt gctttagtct
311151 ggactggttc atagccatca tcttccatca gtacccccaga gattcacttt
311201 gtctcttatg tgggatctgt ttccagttag atgccattat tttcctttc
311251 cttggtttac tcttccacat attggtaaag ctcttccaat agcttttgga
311301 aaggaaaaat gaaaagtaaa tgttttgaat ctctgtgtgt ttgacaatgt
311351 ctttatttta cccttatacc tgattgctgt tttggttggc aaggtatagg
311401 attctttagt ggtctccatg cccagttttg aagacatctg ctagctttca
311451 gtgctgttgc tgtggagtct gaaaatctg cttctggctt ccagggtgac
311501 tactggaaat tgaatgccat tctgttcctt ctcttttgca tatataatcc
311551 attttatct ctcttgaagc ttataggttt atctttgtct caatgttctg
311601 tccctgttaa gagtccattt tcatcctttg tactaggtgc ctggtgggat
311651 cattccgtct gaaactaatg atttcccatc tcttcactgt ttctggaatt
311701 cctgtttcc agatgttaga cctccagaat ttgatctcta attttcctat
311751 cttttctctt aactttcagc tctgtcttct tgctaggacc ttttcctagg
311801 agcatttctc aatttaatct tccagttcat ctgttgcatt ttatttttct
311851 agtctcatat tgtctcatat ttttaatttc taagagctcc ccttctccga
311901 atattctttt tttttaatag catcctattt tggctcatgg ttgcagtatt
311951 ttatctcctt gaagatgttt gtgtgtttat gtatgtatat gcacacacgt
312001 atacatacac atacaggcat gcatctctgt attctttcgg cataatctgt
312051 gtcctccagg gtttgtttct ttgtttcccc tgtatgttg ttttggtcgt
312101 tcacattata ggctttcctc agagttaatg gtcttggtag tctactcata
312151 tttaagtgtg gaacaccaaa aagcttacta taagctgaga gtgtggtaaa
312201 gggctctttg ttttactatg acctacctga gctatcttgc tggggaacac
312251 cctaatgtca gtctctttat aaagggcctt tcattttggc ctggcaagaa
312301 atactctttc atcctcctgc atggagggca aaaaaaaatt taaaaattgg
312351 ctgctagggt ctgtctgctc acttccctgt tttgcagacc ccacactctt
312401 ctgcaattca tttcatagtt gtcaagacta tacaaattgt ccttttaat
312451 gttctctctt ctgctatccc tagttggcag tcttcctctt tacaacctgc
312501 tgaaagtgga agacctccag ttttccttta attcctcagc aaaccaccaa
312551 ctattatatg tctttttcc agaacaactt attttttaac tataattata
312601 tgcatttatg ttagattcac tgaaaacctc atcttgtatg gtgctctgta
312651 ccctatgggt gctaaataaa ggcttgctac tggcaactgg atttaggatc
312701 ggctaattct gcgtcctttt aagatatgct tatttaagcc aaactcggta
312751 tgataatttt tttttttttt tttttttttt tgagagggag tctggctctg
312801 tcgcctaggc aggagtgcag tggcgcgatc ttggctcact gcaaccccg
312851 cctccgggt tcaagcgatt ctcctgcctc agactccga gtagctggga
312901 ttacaggcgc ccgccaccaa gcccggctaa ttttgtatt tttagtagag
312951 acggggtttc accatgttga ccaggctggt ctcgaactcc tgacctcgtg
313001 attcgcccac ctcggcctcc caaagtcctg gaactacagg cgtgagccac
313051 cgcgcccacc cggccagtat gatagttttt aggaggaacc ctcaggagag
```

```
313101 tgattgtttc tcccgctgtg ttgtgggggg tggagtaggg aagcctggcg
313151 tttggggttt ttttgtttgt ttgttttttg tgtgtgtttg tttgtttgtt
313201 tgttttgaga cggagtcccg ctctgtagcc caggctggag tgtagtggcg
313251 cgatctcggc tcactgcaag ccccgcctcc cgattcaagc gattctcatg
313301 cctcagtgtc tggagtagct gggattacag gcacccgcca ccatgcccag
313351 ctaattttg tatttttagt agagacgggg tttcaccatg ttggttaggc
313401 tggtgttgaa ctcctgacct cgtgatccgc cctcctcggc ctcccaaagt
313451 gctgggatta caggcgtgag ccactgctcc cggcgtttgg gttttttaag
313501 ctattcaaat taagactaga ctggaatctg gagcagtgtg tgtgacaacc
313551 cctctctgca cacccaactt tccccgggcc ggctagtgac tcaaagcgac
313601 agcccagatt taagaaaacg aaacctagtg cagctggggc acttccggga
313651 tctcgctatc cggccgccac ccgcagctgc agcacagtca tggcccaggc
313701 gtcgccgccc cggcccgaga gggtgctcgg cgccagcagc cggaggccc
313751 ggcccgcgca ggaggcgctc ctccttccca ccggtgtgta ccgcggggc
313801 gggcgggcgg gcgggcgggg ctgggcagcg acgggcccgg tcaaggggcc
313851 tgccttccgg tcgtggccgc atggggggccc gacctgcccc tactccgggc
313901 cggggcccta gacgccgggg cggcgctgga cgaacttggc tcaccactcg
313951 cgtgcctgtt ggtggggggag ggggccagag gacagggcgc ggcccaggcc
314001 agttccacag gtggctctga ctgcccatgg tttcgcgcga gtggtgggca
314051 cgcttcggtt tacctccccc gcgggtgaca gcccagtgct tccaccacaa
314101 ccgatgtcaa ctctcctagc gcccctccgc tcaccggtaa accaggacag
314151 tggaggggcg ccctgatgcg gtgaggcagg gggcggccct gagggaagag
314201 ctggtctca cgttcacgga ggacgtgact ggaacccgtc tcccccttctc
314251 cagtcgttcc agtcctcccc ggccctctac ttgagtgggt gggtcttctg
314301 atgggttcct gcccttgcgt gtgtgtatag ctccaaacgg tgtgccaggc
314351 tcagggcaag gtcctgagca tacaaagatg agttaggcag accctgccct
314401 agagactcta ctaggcaact ttaatgagga ggtcagaacc acagaggtac
314451 agatgagaga ctcctgactc ccagtcttca gggaaagctt tttgaggaga
314501 ggatggctgg gcttacccctt tttttttttt ttttttttg agaggagttt
314551 cactcttgtt gcccaggctg gagtgcaaag gcgctatctc ggcccactgc
314601 aacctctgcc tcccgggttc aagcgattct cctgcctcag cctcccgagt
314651 ggatgggatt acaggcatgt gccaccacgc ccagctaatt ttgtattttt
314701 agtagagagg gtttctccat gtttcatggg cttaccttta aagggcaaga
314751 ctcagccaaa ggtggaaaag ttgaaggggt gttcccagca gagaggatga
314801 cacaaaggca ccaaaccaca aaacgtcaca cgtaaacatc atacgtggca
314851 accacaagcc aatcagttgg atatttcatt cattggtata catatggact
314901 gtaaggtaag tcacgggaga tgcgcttcca tcctgacctc ttccctcaaac
314951 tccagactgg tataaccaac ttcttccatt tctgaaatga tctcaaactg
315001 agtatgtccc aaagagaatt cttgtttcct ccactgtatt caggtactcc
315051 aaacctgctc aaccaccagc ccattccatt cgcccaggtg ctccttgcaa
315101 aaaccttagt ggctcctcag ggcctctctt tcctccggac accccttcta
315151 atgcatcagt cgggccagcc agttctgtgt tcagcctgac tgtatctgga
315201 gcctgactgc ttctcaccac ttccattact gccacccaag cctacgccat
315251 catgatcttc tgtctggact attgctttcc tggcttctat tctagccttt
315301 aatacaggca ggcctgcaga gcggccaaaa tgctttttga aaaacaaaaa
315351 gcaaatgtga ttctcctact caaaacccac caatagtctc ccatgactct
315401 cagaacaatc tatgagcctg gcctgcagtt taccccatgt ccttatctga
315451 tttgactcct gcccatctta atgactctgc taccctgcta ccttgtaggt
315501 cctctaagcc accaaagctg tccctgcctc aggatctttc catttgctat
315551 tctctgcaag gaaaactcat tgccacatta tcccattttc agttccccat
315601 catattcagg tgtctgctca tatacatctt ccctcaacct tgcctgccca
315651 tcctgtctaa aagagcaccc cttgcccctg ctcctgtcac tctctacctc
315701 cttctgctct attctttctc tatagtactt atcactacct ggaaaacaaa
315751 acaaaacttg tttaatgcct gtctctacca ctggccactg gcatgtaaat
315801 tcgtcttact ctcttctatc cttagtgcct agactggttg gcctagtagt
315851 agtagtagga catagtaggt actcattaaa tattaaataa tagtaagtcc
315901 tcattaaata tttgttgaag gaatgaatgt acttgtatat aacactacgg
315951 agcttgactt ctgtaggtga tggggaaata tgagcagatg tccatttcag
```

```
316001 gtagatcatt ctgacagtaa catagtacat ttccggtaga tcattctgac
316051 agtaacctag cacatttctg gtaaatcatt ctgacagtaa cctagtacat
316101 ttccggtaga tcattctgac agtaacctag tacatttcca gtagatcatt
316151 ctgacagtaa cctagtacat ttcagataga tcattctgac tgtaacctag
316201 tacatttccg ttagatcatt ctgacagtga cctggtacat ttcaggtaga
316251 tcattctgac agtaacctag tacatttcag gtagatcatt ctgacagtag
316301 catagtgcat ttcaggtaga tcattctgac agtaacgtaa tacatttcag
316351 atagatcatt ctgacagtaa tataaagaat gcagtgggat catgacaggg
316401 aaaatagaga caaggacaag agatcactgg aatagactag gtgaaagacc
316451 ctgagggtaa ggcagtccac cttccacacc gctgccagca ctgtctttct
316501 cttaaacaca catgggcaca cacacatata aacatgtgag tgcacacaca
316551 cagatcaagt aagtcatggt ccttccagtg ttaataagca cgtactggct
316601 gcaagtacta caaaaacaat ttgatgtaat ttaagcatga gggatgctta
316651 gtagtagtaa gcaggaaaac cagactcaca gacccccaga gcatggatac
316701 tttagcatct tacagaaagg gctgaggact aggacctgag aagccattat
316751 aaactttgac aacactctcc tttatctctt atttctgcat ctctcagtgt
316801 atctgctttg ttcttctctt tctctggtcc agttttcctg gtgatggtat
316851 agaagatggc tgcccttgca gcctctcagt ttttacatct tctttaagaa
316901 accagcccaa tctgaactga aatcttctat cctgaattct gtatatctga
316951 gagatgagca ggtcctctgg gactatcagc tatgtctaga ggaatgaagt
317001 acaaacatgc ctgctggggg tcattgtgta cgcatcattg tgagctgaac
317051 agatacccta aaggagtcca ttgaatatcc tatccttagg ctccccatgg
317101 tccctcctct ataacacaca catccttatt cctatttata cattctaaag
317151 atattcccag tgatgcattc tgttcccagt aatgaattct agctatacca
317201 aaaccaaatt cagtcacact taacttctgc caaagtcata tctagccact
317251 tcatcctgag ataatgtgat ggaaccattc attctccaag gccattacca
317301 agttccttgc caagcctcta ggtaatgtct actgttttgg tctgtatcca
317351 gttcaggtag gcattcactg gaccagtgat aaaattggct tctacacatc
317401 cagcaaacag tggaagaact aaaatagtaa attgcaataa acactaatga
317451 taaaaggaga agaaaggagg aaatctccaa accagcacca taaattagtt
317501 acctaccagt ccagaacaaa tctatactgg aaggggattc taaatgaaat
317551 gataggatta gtgaatccca ttccaactgt ttcacccatt tctttagtgg
317601 cagaatgtgt tccttgacca cgcttcctgg ctaccccaga ttctgtgccc
317651 tgggtggatt acccttggct ggagggcttt aagagtagaa gctagagcct
317701 cggcaatcca tttccacatt gaagagggcc tgcagattgc cggagagatt
317751 aagaatcact gtgttgtttg aattagtcat agttcttata ttccaggctt
317801 gtgatctttc tgtggtttca ttctgtataa actttcttgg ctctcagttt
317851 catttgtgag aattctaaaa ttctgcaatc ttgtcgggtc aggctctgtg
317901 agtcctcagg gttgctaaac cccctagaa aggagcctgg aaagccctgc
317951 tgactattct tggtcccagc tactgatgaa aaccaatggg ctcttcccta
318001 aaatacctca gccttcatga cacacccttta ggtatccctc cctctctgaa
318051 tctgtacagt tcctgagttc agatggtgag ggataccaaa ctgtccaaat
318101 gtatgtggtc catgagtttc ggataacaca tagcaagagt tcagatagtg
318151 agagatgcct gtctgtgtaa aagtcctcag tgtgactccc atagtgagag
318201 atgcctgtgt aaaagtcctc agtgtgactc ctccaactgc agagaattac
318251 acacttcctc cagtctagaa gatcaaaaga gctagaagag ccgaaatcca
318301 ttaagacact gtgatatggg gggatttagc aggaaaaagc cactagggag
318351 aacctgtggg tcccacccca tgttttttaat ccatctgcac tgaagacaaa
318401 ctctgggtct agcacagcag tgttgtcagc atatctgtct tgtctgtctt
318451 gttcttctct gtattccccg ttgtcagaga atacaaacca cctctgtatt
318501 cccagatgcc aagactcttg gaacccaagt acttgggagc tcagctcagg
318551 tatcagtgac ttgacagctc tgcccagtgc acagaaacaa gcaatgttgt
318601 acaaaaatgt tcagccctta tacaacaaga ggcagctgca tatcctgtca
318651 gatagtatcg ctttttaattt gggagtcacc aacttttgtt ttttttttt
318701 tttggttttt tttttctga aatggagttt tgttctcatc gcctaggctg
318751 gagtgcaatg gtgcgatctc ggctcaccgc aacctccacc tcccagattc
318801 aagcgattct cctgcctcag cctcccgagt agcggggatt acaggcatgc
318851 accaccacgc ctggctaatt ttgtattttt agtagagacg gggtttctcc
```

FIG. 5 CONT'D

```
318901 atgtttgtca ggctgctctt gaactcccga cctcaggtga tccgcctgcc
318951 tcggcctccc aaagtgctgg gattataggt gtgagccact acgcccagcc
319001 ccactggctt tttttaagcc tgtactttac aagttttaat gtctgttttg
319051 agtgtccttt aataagaaca cagtattcta tcaaagtaga ttttgggtct
319101 gaggtaatta gaatattggg atgttttttcc cccagtttca tcctagggca
319151 ggggactttg tgttgtcaaa tattaacata tattctaaaa cattgaaaat
319201 tttaagtgta gcattgttca atggaataaa acagaagcac aggaggaaca
319251 gatccaacta tatgaaaagg agattttaaa ttagtggcta accattatga
319301 ataaagtta gattcccatc tcatacatta caaaacaatt tattctatgt
319351 tcatgaatag tttaattctt ttttttgtttc attttgtttt gtttttttga
319401 ggagtttcgc ccttgtcgcc caggctagca tgcagtggtg caatctcagc
319451 tcactgcaac ctcctcctcc caggttcaag tgattctctt gcctcagcct
319501 cccgagtagc tgggattata ggtgtccgcc accatgcccg gctaattttt
319551 gtaatttttag tagagacagg gtttcaccat gttggtcagg ctggtctcga
319601 actcctgacc tcaggtgatc cacccgcctc ggcctcccaa agtgctggga
319651 ttacaggtgt gagccaccgc gcccggccaa tattttaatt ctaaaattaa
319701 attaaggcag gacatggtgc ctcatgcctg taatcccagc actttgggag
319751 gctcaggagg gaggatcact tgagcctagg agttcgaaac catcctggac
319801 aacatggcaa gatccctcct ctacacaaaa atttaaaaat tagctagatg
319851 tggttgcatg cacctgtaat cccagctact tggaggctg aggtgagagg
319901 atcacttgag ctggggaggt tgaggctgca gtgagccatg atcatgccac
319951 tgcactccaa gcttgggtga cagggcaaga ccctgtctca aaataaataa
320001 attgattaat taaaataaat taaaattcta gaagaaaaca gaggtaagtg
320051 ttttctatgt ccatctcacc caagagcaga aatcataaaa taaatgattg
320101 ttgtaatttc atcaagtaaa acatttaaat attctgtata tcaaagaata
320151 ttataaacaa agttaaaaga ccacatatat gactaacaaa gggttaatac
320201 cctgactgtt ataaaccaat aagaaaataa taattcaaca gaaaaatggg
320251 ctaaggacat gagtgcctta gagaagaaat gggattgtga ccttactgca
320301 tgttacattc gtaagtccag attatgatcc acttctctct gcatttcgtg
320351 ttctttcctt tgacttcatc atctaacctt ctgtcctaac tgtaccttga
320401 taatacgttt atttgtttgt ttgttttgag acggagtttc actcttgttg
320451 cccaggccac agtgcagtgg cacattcttg gctcactgca acctctgcct
320501 cccaggtcca agggattctc ctgcctcagc ctcccgagta gctgggataa
320551 caggcatgca ccaccacgcc tagctaattt ttttttttaa tgtagtagag
320601 atggggtttc accatgttag ccaggatggt ctcgatctcc tgatcttgtg
320651 atccacccac ctcggcctcc caaagtgcag ggattacagg cgtgagcacc
320701 gtgcccgacc aagattgacc ttcttaaaca actttgtcat catgtgcttc
320751 tcctgctcag acatcctcct tggcagcctt tcaacacgtt tctcaaatcc
320801 tttcccagct tcctgtgcag cctttcctcc tcagcctggc tgccttactg
320851 tctcagctcc gatctctggg ccttttccca tatggctgct tccctctaca
320901 gtgttcctcc tagcccatac cccaacccac cccaccttc cctcctctcc
320951 aggttgtacc agttccaggc ccctgcccctt gacaatactc cttcccacga
321001 ggagcacttc ctcggctacc tccttagcgt gtattggaat tcccactcac
321051 ttggcagttg cactttgtga cacttaattc tgccattta ttttcctaac
321101 tgctatttag tctccctgtt tatttcgtaa gcttcttgca gacaccagtt
321151 ctatctcacc acatttcttt acgtcctctg ctctactatt cactagagga
321201 gcccctcacc acagatagct gttgagcacg tacaatgtga ctggtcctat
321251 tgagacatgc tttaagcaca gaatacacac tggacttcaa agactctgta
321301 caaagaatg aataactttt atattgacta aatgttgaaa ggatgtaagt
321351 tctttgacat atttggttgc ataaagcaca ttattagctt cacctgtttc
321401 ttttttgggt tttttgtttg tttgtttgtg tcgttttttga gacagagcct
321451 cattctgttg cccaggctgg agtgcagtgg cacaatttca gctcactgca
321501 gcctctgcct cctgggtgca agcaattctc gtgcctcagc ctcccaagta
321551 gctggaatta caggtgtgtg ccaccatact gggctaattt ttttgtattt
321601 ttagtagtga catgttggcc aagctggtct tgaactcctg acctcaggtg
321651 atccacccac ctcagcctcc cgaagttctg ggattatagg cgtgagccac
321701 taggcccagc ctcctttttg attttttaa tgaggctcct agaaagtttt
321751 cagtgatatc tgtggctcac atttgtgtct tgttatatgt ttcttgttgg
```

FIG. 5 CONT'D

```
321801 acagcatcgg tctagagtgc acaacatagt gactcaaaca caagaaatgc
321851 tctcaggctg ggtgcagtgg ctcacacttg taatctcagc actttgggag
321901 gccaagcagg ctgatcttga gcctaggagt ttgagaccag cctgggcaac
321951 ataatgggac ccctgtctct aaaaaaaaaa ataacaaaaa ttagccagac
322001 atggtggcct atatctgtgg tcccagctac tgaggtggga gactgaggtg
322051 ggaggatcac ttgagccctg gaggcagagg ttgcagtgag ccatcattgc
322101 gccactgcac tccaacctga gtgacagagc gagactctgt ctaaaaaaaa
322151 agatactccc cagcccccg cccggccagc cgcccgtcc gggaggtgag
322201 gggcgcctct gcctggccgc ccctactggg aagtgaggag cccctctgcc
322251 cggccagccg ccccgtccgg gaggaggtg ggggtcagc ccccgcccg
322301 gccagccgcc ccgtccggga ggtgagaggc gcctctgccc ggccgcccct
322351 actaggaagt gaggagcccc tctgcccggc caccacccg tctgggaggt
322401 gtacccaaca gctcattgag aacgggccag gatgacaatc gcggctttgt
322451 ggaatagaaa gggggggaaag gtggggaaaa gattgagaaa tcggatggtt
322501 gccgtgtctg tgtagaaaga agtagacatg ggagactttt catttgttc
322551 tgtactaaga aaaattcttc tgccttggga tcctgttgat ctgtgacctt
322601 accccaacc ctgtgctctc tgaaacatgt gctgtgtcca ctcagggtta
322651 aatggattaa gggcggtgca agatgtgctt tgttaaacag atgcttgaag
322701 gcagcatgct cgttaagagt catcaccact ccccaatctc aagtacccag
322751 ggacacaaac actgtgagaa acacccaaga atgataaata aaaaataaat
322801 aaaaaaataa taaaaaaata aataaataaa aatgaaaaaa aaaaaaaaga
322851 tactcccaaa ttttgggttg ttagacatga atgaaaaaaa cagctagctc
322901 attccgtctg agcagttttc actctatctt acccttttttt cttgcttggt
322951 gggaagctgg ggactgttaa tttgtgtccc cggtaggtgg gacccaaatc
323001 caagaaacag aaattaaaga agaaactgat cagaatgtga ataaacgct
323051 agctccaaat gcagccttct gacttggtga aatgaaagac ctaacttaaa
323101 gagacagaga agagatctgg ataacagaag agacttaggg atcacttaag
323151 cagttaacct catctaaatt gaaaactttt cccattaaat ggtaaaataa
323201 atctttcttt caaaactaaa atttgaaaat tataaataaa agctgttttc
323251 tactacagaa aatcaaagga agtaagagga tgaacattgc aatgggcaaa
323301 aaatcttaa acgaattctt gtggccaaat agcaaataac cagttcaaaa
323351 actttgcctc ttactgacac atgggtggag atctcaacag ctggcttct
323401 tctccctctc tctgcctctt gccttttctt cctacctctt cttcccttag
323451 atttctttcc ttttttccat tcttcgcctt aaaaaaaaaa tctacttcct
323501 accttcatgt atctttccta atcatgatat tgaattaaag cacacttaaa
323551 gtacattgct catttatgtc tttaattctc atagaattta ttttttgaata
323601 cagtatggca ttaggattct aactttttaa atagataatt aaccagagca
323651 ctatttctta atatgccatt gttttcttct tcatttgtag tgacaataat
323701 gattattatt gagagcttgc tatgggcaaa gcagtgtttt gagaggtttg
323751 cctgtattta aattcctggt tgtgtttctt gaataaaggt cttcctcatt
323801 ttggccaggc acagtagctc gtgcctgtaa tcccagcact ttgaaaatgc
323851 caaggcagaa ggatcacttg aggccaggag cttgagaaca gccttggcaa
323901 ggtagcaaga ccccggtctc taaaaaaaaa aaaaaaaaaa ttagctggct
323951 ttggtggcat gcacctatag tcccagtgac ttgagaggac cacttgaggt
324001 tgggagttca aggctgcagt gagccactgc actccagcct ggtcaactga
324051 acaagcctct tgtctctaca ttttaaaaag aagaagttat cctcattatt
324101 aggcatttag aagtgaactc attaattctt ttcttctatt agcatagtaa
324151 aaaataaaaa ataaatagct ttttcacttg ggtccccaat attttgtctc
324201 tctgggaatt aagactctct cataaaaaca agtgccctgc cttccacttg
324251 aagactggaa gaggagttag tgagaccaag aaattccact tttccatttc
324301 tcaccaggga tattacttat aggtgtcttt caggttgcag aaaagatgga
324351 aaaaggaca tgtgcactct gccccaaaga tgtcgaatat aatgtccat
324401 actttgcaca atcagagaat atagctgctc atgagaattg tttggtaagt
324451 tacttgaaaa catacttcaa agtacatgag tactttagt gtaggacaca
324501 taagaataga taaacaacac tttggacaca aagaataaca agttggccat
324551 ggtttgagct tttaggtgaa gattgggag catttctttt tttttttttt
324601 ttttttttg agacggagtt tcactctgtc acccaggctg gagtgtggtg
324651 gcgcaatctt gaatcactgc aagctccgct tcccgggttc acgccattct
```

FIG. 5 CONT'D

```
324701 cctgcctcag cctcccgagt agctgggact acaggtgccc gccaccatgc
324751 caggctaatt tttttttgtat ttttagtaga gatggggttt caccgtgtta
324801 gccaggatga tctcgatctc ctgacctcgt gatctgccca cctcggcctc
324851 ccaaagtgct gggattacag gtgtgagcca ccacgcccgg gcctggggag
324901 catattttc tgactttgaa ctgtttcaga tttaaaatat aacagacact
324951 gatagacctt ctacccaggt ataatttcta tcaaagtcta cagaattctg
325001 agatttatcc atgttggtaa acatagctct aagtccttca ttttaaatat
325051 gatgttcgat ttcatgacta tattaccatt aactgttctg tgaatgggca
325101 tttagttttt ccagtattgt tttctatgac taacaagtcg tcatgaacat
325151 tcttgtctag gtctccttct catgtgagaa tttccctagt ctaggctata
325201 cagctaagag cagaattgtt aggcacagga atggggtgtt ttgtacttga
325251 ctaaatacac caaattgttc ttcaaagaga ttgtaccatt taatacacct
325301 aacttaccaa acatcatagc ttagtctagc tcaccttaaa catgttcagg
325351 acacttacgt tagcccacag ttgggcacat catctaatgc aatgcctgtt
325401 ttataacaaa gtcttgaata tctcataaaa tttattgaat actgtataga
325451 aagtgaaaaa cagaatggtt tatgggtact atacaggagg atgtgtgtag
325501 gttatatgaa aatgctatgc cttttagata agggaactga gcattcacgg
325551 atttggtag ccttgggggt tcctggaacc aatcccctgc agacactgag
325601 ggacgactgc actatggctt tattactagc cttggctttt attttggcac
325651 tttgaatttg tggatcagct tttcatgttt gaccaaaata ccttttggaa
325701 ttttgattgg aattgcattg catttataga tgaatttggg aaaaaaatag
325751 acacattcat atattataat atattataaa taattaatat aaataattag
325801 agagacaaaa cctgttaatg gatgggaaaa agatgcattc atatattata
325851 tgtattaata tattattaat gcagtatgta ttaatatatt attaatgtgt
325901 tatgtattaa tatattattg tgttatgtat taatatatta ttaatgtgtt
325951 atgtattaat atattaatta tatattatat aaatataaat aatatgcatt
326001 ttatataata tattactata ttcatatatt actatattca tatattcata
326051 tataatatat tactatatta tatattataa tatatgaatg tgtctttttt
326101 tcccatcca ttaacagagt ctgtctctcc aattatttag gtcttttata
326151 aatttcaaaa ctgttaaata attttatct gtagtcatat agaacttggg
326201 gttgggcata ttcctgggca agttttttgt tttgtttttgt tttgttactt
326251 ttttctaaaa gcttttaaa tgaactatta tcagtatata taaacactat
326301 ttatttttat ttattgatct catccagcaa ccttaccaaa gtcttattag
326351 ttctaaaact tctctagatt tacctggata tattgtatgt ggacaatcct
326401 catctttaaa taagaacaat tttatttact tacccttttaat tcgggggact
326451 cttaatctct ttttcttgtg ttttttccaga acattcaatt atagcggtga
326501 ttacaagcaa ttaaatttgg aagccctgtc ttgcttctga tattaatggg
326551 atgctccaaa aatcttatca ttaaatttgt gtatgtttta cattcttaat
326601 gatttcattt aattaaaata aggaagttac ctttatctct aatttgctaa
326651 aaattatagc gtattgaata ttactaaatg cttgttctgc atctattgaa
326701 atgatccggg ttctttttct ctctctggcc acaaacagtg ctaaatgctt
326751 tatttttattt cacttttta tatacataat ttgatgttta ttttaaatta
326801 caaatttatg gaaaagttgc atatacagta caaagaactt ttttttggtca
326851 gaaccatttt aaattaaatg atatgcaatc tatcctgaat actttagtat
326901 gatttttttt tttttttgag acagagtctt gctctgtcgc cccaggctgg
326951 agtgcaatgg tgtgatcttg gctcactgca acctccactt cccaggttca
327001 agcgattctc ctgcctcagc ctcccaagta gctgggatta caggcacatg
327051 ccaccacgcc cagctaattt tttgtatttg tggtagagat ggggtttcac
327101 gtgttagcca agatggtctt gatctcttga cctcgtgatc cacccacctc
327151 agcctcccaa agttctggga ttacaggcat gagtcactgt gcccagcctt
327201 tagtatgtat tttctacaaa taaggtgata tgctttggct gtgtccccac
327251 ccaaatctca ccttgaattg taataatccc cacgtgtcaa gggtggagcc
327301 aggtggagat aagtgaatca tgggagcagg ttttttcccag gccattcaca
327351 tgatagtgat agtgaataaa tctcatgaaa tctgatggtt ttataaagag
327401 gagttcccca aaaatctctc ttgcctgctg ccatgtaaaa catgactttg
327451 ctccccctta ccttcttccg tgattgtgag gcctctccag ccatgtggaa
327501 ttgtgagtcc attaaaccctc ttttttcttta taaattaccc agtcttgcgt
327551 atgtctttat tagcagtgtg agaactgact aatacacaag gacattctct
```

FIG. 5 CONT'D

```
327601 ctcacactat aacaatataa acgtcaaaat caggaaattt tgttatacta
327651 ctaccgtcta ttcctcaaac cactgaggtt tcacctgttg tactaataac
327701 gtgtgtgtgt gtgtgtgtgc ttttttttg agacaaggtc tcactctgtt
327751 gcccagggct agagtgcagt ggcaccatca tgcctcactg caactttgac
327801 ctcctgggct caagtgattc tcccatctca gcctccagag tagctgggac
327851 tataggcatg tgccactgtg cccagctaat gttttgtact ttttgtagag
327901 atggggtttt gccatgttgc ccaggttggt atccaacccc tgggctcaag
327951 caatcctccc acctcagcct cccaaatgct ggaattacag gtgtgagcca
328001 ccatacctgg cctaataaca tttttataa caaagattt tagctcatgg
328051 gttgcatttg gttatcatgt cttaagtttt ttcattttat tctgttagta
328101 atgtgtgttt tacttatata ttttttctgc tgtgaaacca ttcttagatt
328151 aacaccattt aatggtgatg ttttatttt acttatttat ttgagacaag
328201 gtctccccag gctggaatgg agtggcataa tcatagctca ctgcagcctt
328251 gaactcctgg gcttaagcaa ttctcccacc tcagcttgga ctacaagcac
328301 gtaccaccat acccagctaa ttttttattt atcttttgt agaaatgggg
328351 gtcccactat gttgctcagg ctcatctcga actcctggcc tcaagtgatt
328401 ctcctgtctc agcctcccaa agtgttggga ttagaggcgt gagctaccgc
328451 tcccagccca atcgtgatgt ttttattcta atatactgtt gatgttgatt
328501 tgctactatt ttttagttaa ctttattggc ataatttaca taaaatcaaa
328551 tgtacccatt ttaagtgtcc aattcagaaa gttttgagac atgttgagac
328601 ccatgcaacc actaccacca tcaagatata aacatttcca ttaccccaaa
328651 gggtttcctc aatgttctgt gcaatcaatt ccttcctacc ccaagtccct
328701 gtagatttgt cttatctttt ctcagatttc atatgaaagg aatcctatag
328751 ttgtcctcct ttgtgtcact tcctttgctc agcatactgt tttagatgca
328801 tctatgttgc atgtatctgt atcttgttcc tttatcattc ttcacagtac
328851 ttaattggta tgcatgtatc acaatttgct tattcattca tctgttggta
328901 gacatgtgtt atttccagtt tggagctctt atgataaaaa tcagctataa
328951 gcatctgtat atgagtcttt gtgtctttat ttaggccttt cataatttca
329001 aaattgttca atggctttt tttttttttt tgagacggag tttcgctttt
329051 tttgcccagg ctggagtgtg atggcgcgat ctcggctcac tgcaccctcc
329101 gcctcacagg ttcaagcagt tctcctgcct cagcctcgcg agtagctggg
329151 attacaggca cctgccacca tgcccagcta atttttgta ttttagtag
329201 ggatggggtt tcaccatgtt ggcctgactg gtctcgatct cctgacctca
329251 ggtgatccac ctgccttggt ctcccaaagt gttgggatta caggcgtgag
329301 ccaccgcacc cggctattca gtaattttta tctgtagagg tatagaactt
329351 ggggttaggc atattctggg cttgttttt gttttgtttt gttacttttt
329401 tctaaagtat ttttaaatga gctattatca gtatatatga acactattga
329451 ttttttattta ttggtctcat ccagcaaacct taccaaactc ttatcagttc
329501 taaaaagtct ctagatttac ctggatatat tgtatgtgga caatcctcat
329551 ctttaaataa ggacaatttt aatttggggc actcagtctc cttttcttgt
329601 ttggttatgt ttgtcttggg taaatagcta gaagtagaat tactgagtca
329651 taaagttagt gtatgtttaa ccttaaaagt gattgcatta ttttacattt
329701 ctaccaataa tatgtaagaa tttcatttgc tccacatcct catcaacact
329751 gggtcttgtt attttaggca gtctagtaga tatatattgc atctcactat
329801 ggctttaata tgcctaaggg ttaatgatat tgagcatctt ctcatgtgct
329851 catttgccat tcataaacct tctttatga agtgtctatt caaattttgt
329901 gcccactttt aattgaattg tcttattatt gagttgtaag tgttttctaa
329951 aatctggata caagtctttt gtcagagata tgtattgtga atattttctc
330001 ccagtctctg gcttgcctct ttgttttctt agcaatgtct ttcaaagaca
330051 attttattt tgatggaatc caacttactt tttctttatg ctttctgatt
330101 tttataagaa atcttcgcct atgccaatgt caccaaaatt tactctttatg
330151 tttctcatgc ccttttgtta tttgagtgta atatgtgaaa cattgatctt
330201 caattcagat ttggagtctt ctggtttcaa gtagcacata gagacttgag
330251 ccagcctaaa cataaaagag ggtttatgat aaggttttgg gggcatttca
330301 tgtttcctaa aggcaggcat gcaggtgggt gtaagaaaca gctagaaagc
330351 cattgggaac ctagaatgtc ctctttctag cccttgtttt tcttttcttg
330401 cagactgact tgctctaacc acgtggcttc agctattgct caaagcccat
330451 tccacacttt taggataggg gatcagactg acccagcttg gcatcagggt
```

```
330501  tccacccagg tcaatgagtt attagaggtc aggattacaa agtataaaac
330551  atgcccggaa accagggtca ttcccagaga aatgggatgg cttatggtct
330601  gctcatccac ccccaaagtt gccactgttt taccccccagt ccatttccca
330651  ctcctggttt gattttccac ttttggtatg attttctgac atgtagcttt
330701  caatattact ttgtgcatac tctggatttt tttttccaat ctgcagctgt
330751  attcttcagg acttgtggaa tgtgaggatc aggatccact taatcctgat
330801  agaagttttg atgtggaatc agtaaagaaa gaaatccaga gaggaaggaa
330851  gttggtaagt gtaaatgatg ttatttctta tactggatga acagaccctc
330901  aaggaatgca ttccaaagga gtctatttga ctgatacacc agggatagag
330951  aagcatcttg gagagctgga agaagtagga actgtattgg aaacctcaat
331001  tcaacttaac atttaatttt tttttttttt tttttgagac ggagttttgc
331051  tcttgttgcc caggctagag tgcagtgaca cggtctcagc tcactgcaac
331101  ctccgcctcc tgggttcaag cgattctcct gcctcagcct cccgagtagc
331151  taggattaca ggcacgggcc accatgctcg gcaaattttt gtattttag
331201  tagagacagg gtttcaccat gttggccagg ctggtcgcga actcctgacc
331251  tcaggtgatc tgcctgcctt ggcttcccaa agtgctggga ttacaggtgt
331301  gagccaccac gcccggccaa catttaatat tttaaaataa actaccatat
331351  acttcaccag taaagtgatc tgagttagaa tgcttttgct gtaagtagaa
331401  gaaagctcaa gtcaaacaga cttttacaaa gaggatactt acttttcac
331451  ttgatcagag aaaacacctg ctttccaagt tggttgattg agtggcttga
331501  taatgtcatc aggggcccag gttcttcctc tctggcctcc tgtccccaac
331551  atcagctggt cccattgtgg tcatagggtg gccgcaggca gcaactgaag
331601  catcaggctt tcttgttcat acccagtgaa agacaaaggt catccataca
331651  catggaataa gccccttct gaaagtttca ttaggttgca cccctctttc
331701  tgcaccaact gctggggtg gccataacta atcagggtc agctcctcat
331751  gggtcataag ggggctattc aaggaggaag aaatgctgag aagtcattcc
331801  actgggctta ttgcagcgac atcctctcaa ggacccttca catcttagca
331851  agcaggacag caagtgtgag cacctcacat tctgactaca accacagggt
331901  taataaccag ggacaaatgt atagttagtc tttgcaaggc atcagcatca
331951  gcagcatcct gtggtaggtg tgttacatac attgctctag gtaaactccc
332001  agctataggt aaaatgatgc ccattttaat cgaagaaatg gaaagtgcag
332051  ggtgaaaggc aacagtccag atggaattct gcaaattatg ctatcttagg
332101  cagtgtacac aatactgtag taggtcctga agcaagccat aaaaatggac
332151  tgtgtgtggc ccgggcatgg tgctgcatgc ctctaatccc agcactttgg
332201  gaagccaagg cagttgagga ctgcttgagc ccaggaattt gagaccaacc
332251  tgggcaatat agtgggaccc tgtctttacc aaaaagaaa aaaaaattag
332301  cccgacacag tggcatatac ctgtagtccc agctacttgg gaggctgagg
332351  taggaggatt gggtgagcct ggaaagtcga ggctgcagtg agctgtgatc
332401  acaccactgt actccagcct gggcaacaga gtgagactct gtctcaaatt
332451  aaaaaaaaaa aaaaagagtg tgtggatcct gctctcaatg tctatgctat
332501  tactaattaa tacttggcaa gactggctgc tgacatcatt agtgctgaca
332551  atgccacatc cctaggattt tgggtgtgat gagatgggtg aactgattag
332601  aaagtagcag acagacctca actggaatat ttttttgctc ttcactaatt
332651  ggatttgagt ggggagacac agagttaaag aaatctctgt gaaattctag
332701  tagccatcca gttatgaaga gacccaggct gagaaatgag ggcagttgat
332751  tggaggcata atatttgggg gaaagcaggt acctgagggt ttctgcggac
332801  cttgggatgc agacttccct actgggaagg ctttgggatg ggttggaagt
332851  ggaggataaa ggagagaaga gaggaaagtc acctgaggta atagttaccc
332901  tctcacagca tttatgaaac tcttggacta tgtgggcaga tacatggcac
332951  acacccaggg tggggacagg ccagtgctgt ggtattttca gtaagctggg
333001  caagtacctt gagggtgagc agcagggggcc ctcagcaagc aggctcctcc
333051  ctaggattca gactaccaat ctgacagagc cacatggaca tccaatagca
333101  tttcagagta aagtggccaa aaaagtacag ttccatctcc tatacacaca
333151  cacacacaca cacacacaca cacacacaca cacacacaca cattctccat
333201  ctaaatctgc tcataaaaac agcactatca ttatccattt gcccaagcca
333251  gaagtctaag gactctcttt tcctcgtcaa cctcccagcc caacaccaag
333301  cccatgggca cgaactccta ggtgcatctt gcattcatcc acccacttct
333351  ctcagcgtca gtaatccacc atagcggagt cacccatctt gttctctaaa
```

FIG. 5 CONT'D

```
333401 gcgagtactg acactcgccc gactgtctct cctgccatcc ctaccccagc
333451 ccgtagttct ccacccagca gcagcccagc agcctgagtg atctttcaat
333501 aatgttaatc agtttatgtt ccccgtgcag aaagataaaa cccaactcct
333551 tactctggca tgtaagtcct acgtgaccca gcccttactt acccctttga
333601 tcatcctgag acttccctgt gcccacttcg ctgctccaac agcactggcc
333651 atctgtcttg tcctcgctgt agcttgccaa tggggaagct cattcttgcg
333701 gccaagaccc aaggccctct gcttagaatg tctttcctcc tcctttttgc
333751 atctgggagc tcttactatt attcagatct cagcttccat atcacctcct
333801 tagaggtgac ccatttact aactgcccag tctgaagtag ggacccagtg
333851 acactgtcac ttcaccctat tttaattcga tataatgtgt atataacttt
333901 gtgagacgtt ttaaacttg ctttatttga tcattgtacc ttgtctccaa
333951 tagaatgtaa gcttcacgtg acaggcatc ttttctgctt tgtccactac
334001 tgttttccct tatcctaaaa ccatgcctgc cacatcatag ctactgcatg
334051 ctaaataaat actatatact catgtatttt taaatgaata aatgtttatt
334101 agccatttgt attttttctt ctgtaatttg ccagttacca ttttctgca
334151 ggttatcaga atcttaaaac tttatctagt atgctacaaa cattcttct
334201 tcaatctttt ccttgtcttt taaatatttt gaatgccctc actataaat
334251 ggaagtttaa aattttgta tagtaggttc tgtcagtttt tgtttttgaa
334301 acagattctc cgtctgtcgc ccaggctgga gtgcaatcac agctcaccgc
334351 agccttgatt tcctggcccc aagccatctt ctggcttcag cctcccaaat
334401 agctgggact acaggagtgt gccactatgc ccgctgatt tttaaagttt
334451 tttgtagaga tgaggtctca ctgtgttgct caagctggtc tcgaactcct
334501 gggctcaagc aatcctcctg cctcagcctc caaagtact aggattacag
334551 gcatgggcca ccatgcccag cctgtcagag ttttcatttg tggcttctgg
334601 gttttcttcc tgccttagac agccttcctt gcctccatac tacgcttttt
334651 ttctttctcc tatatttcct aatctttaag agtttttgt ttaacattgt
334701 tatctggttc gagctttaat ccatgtacaa cttattcagg agtatattgt
334751 gaggtaggga tctaacttta ttttttcct atatacatag ccagttaccc
334801 tcctcccaaa ttaaatgatc gttcttgtat gctctgattt gaatttccac
334851 cgttatcata accttatttc ttgcctatat ttgaatttcc tttaactgtt
334901 tctatgcttg cttgtgccga ccctgggcta tggtgtgagt gacctcctgt
334951 tctgcaaggc aatttcactg tgcccccacg tcattcagcc agagtatcat
335001 gctgatcagc cttggtcctg gctggattcc cctaaaccag ttaggctgct
335051 gtggccacac actgcctagc catcatgaca ccactgtcac atataaaata
335101 ccagatagat aaatacaagc cagggatcaa ataaattgaa ccaagaaaaa
335151 actgttaata gagttgtaga attttaaaa attttggcc ctactaccta
335201 gattcccta ctttatctca cattatcctc aatggcaact ctgtaagaca
335251 gatattatca cccacagcag gttctgagtc cgaaagagaa atcacaccac
335301 tctccgtggc acagccagcg accaatctcg cctgtctcaa agggcccct
335351 agtggggccc cttcctgga gctggacaag tttgcccact ctgctttta
335401 gaaaattctt tttaaaagac agagactgtt tttttgaaac aaaaagcatt
335451 tttctgcttt taatcagatc attacaaaac tgtctgtcca agcattccgg
335501 ttagctgagg tttcgctgaa attcccaaat gagcagccaa atataagtac
335551 tgtaccctaa tgtttgtaac gggatggaat cttgctgatg atgcccagga
335601 taaaatgcag ggcttctgga acttaaataa catttaatga tatctttgaa
335651 ttttaacaaa taacaacaaa caggtactta ctcagtaaaa tctattcttc
335701 tgtagaaatg caaatttgt cataaaagag gagccaccgt gggatgtgat
335751 ttaaaaaact gtaacaagaa ttaccacttt ttctgtgcca agaaggacga
335801 cgcagttcca cagtctgatg gagttcgagg aatttataag tatttaataa
335851 aacatttta aaaccacatt tgggggattg ggataaggaa tggttggatt
335901 aagacaagga gactttgaag actaattta tgtaaatggt tttcaaatga
335951 gaacaaagcc agtttggggg atgcacaggg gttatgtgaa ttttgaattt
336001 cagtgaaaaa tctatatata tatatatatt attttagtca caatatcttg
336051 aataatgaga tcaatgttag gacagcatgt ttttttaaat atgattttg
336101 tgagctatgt tacattcgta agatgatttt taaaaattcc attcagaggc
336151 tgatgttttt cctgccagtg ggcatatatt cctaattttc ccatagtgtt
336201 ccaggcacta tttatttat ttatttaata accacttgct ttatgccagg
336251 catagttcta agtgctttac aaatgttaac tcatttaatc ctcataatag
```

FIG. 5 CONT'D

```
336301 tcaactgagg tagatactat tatctccatt ttccagagga ggaaactggg
336351 gccttgagac actcagtgac ttgtccccag gttacacagc tggtcagtgg
336401 cagagctggg ctgcaggact tccaagtcct cgctctttgc caccttgttg
336451 tcttcaggta tggggactat atattctaaa acaagagggc aagcctacca
336501 ttgaaagaag cttgctaaat aattttttt tttttttttt tgagacagag
336551 tctcgctctg tcgcccaggc tggagtgcag tggcgcgatc tcggctcact
336601 gcaagctccg cctcccgggt tcacgccatt ctcctgcctc agcctcccga
336651 gtagctggga ctacaggcgc ccgctaccac gcccggctaa ttttttgtat
336701 ttttagtaga gacggggttt caccgtgtta gccaggatgg tctcaatctc
336751 ctgacctcgt gatccgcccg cctcggcctc ccaaagtgct gggattacag
336801 gcgtgagcca ccgcgcccgg gctaataat tttaaatctg atttcgagca
336851 agttccgtaa gtattttgtt gctaatcaga catgaaatgt gtaaatatgt
336901 aaatttcgta ctgcacttct ttttatattt gattcactaa gaaactcaca
336951 ggttgttata gtctcagagt ttcatttta ttatttacct taccaaagag
337001 ctcgttttag tatgaccttt acaatgacct taaacacaag atcaaatgaa
337051 aaggaatgtc cctgctatag cttaaagttt gaaaaaatat actgatcaca
337101 cccattagaa gaactaacaa atagggactc aataaaacag tcttcttgca
337151 ttgttttatc aaggaacagg tgaatttta cgcattttta aactgaattt
337201 aaaccttcat gcctatcata catgaggcac cttgctaggt gctacgagat
337251 acaaagaata aaatatagat tgaacctcag agaagttatc acctggtggg
337301 aaggccagaa gaagggtcaa tgcaaacaga agcacatggg ataacgagag
337351 caggaggggt tacatgaaag gagcttggcc ttgagaattg ttgacactgt
337401 ggaatggatg gggacatggg ggttcatcct gatattttca acactgtttt
337451 atatgtttga aaaaatttaa gtacttggga agtgaaagtg ctcagagata
337501 ccagaatcaa agtgggatga gattaacttt gtttgggtgt tgctgggaag
337551 actgcatgga ggaggtggga actggtataa gatgggaaga acggtattc
337601 ccctaggcaa ggaggccact gcttcctgag agtcagcgcc atctgaagag
337651 gaagggagat gaagctgggt gccgaggagg aggaaaggtt agaaagtggc
337701 ctgagcagct ctataaaacg attcacttca tttctttgt tttgttttgt
337751 tttaagacag agtcttgctc tgtggcccag gctggactgc aatggtgcga
337801 tctcagctca ctgcaacttc cagcctcctg ggttcaagcg attctcctgc
337851 ctcagcctcc tgagtagctg ggtctacagg cacgtgccac catgcccagc
337901 taatttttgt attttagta gaggcggggt ttcaccatgt tggccaggag
337951 ggtctccatc tcttgacctc gtgatctgcc cgcctcggcc tcccaaaatg
338001 ctgggattac aggcatgagc caccgtgccc ggcctcactt catttcttca
338051 tcatagcctg ctatgctgct gctttctctt ggaagatact aatcagttct
338101 aggccctttg taggtcaaat ctaagatctg gggcaaatac ctgttttcat
338151 cgaaaatgac ttttttcctta aattaatgct tgcaattttg tgctatttat
338201 tgttgaaaac cagcagaatc ttgtacagtc agatggaaat ctgcatgtct
338251 tagattgtgg atctttaggt atctttatac agtaaaatct cactgaccac
338301 tgtatatgaa ctagtattgt tcataatact tcatcagtac tcattccttg
338351 aaagaacata atcatcttcc taagtccctg agggcataaa agacatctaa
338401 ctgagtctcc atctgcactc agtgtgggtc actaattta cacagggctt
338451 caaaaaaaa aacttagtg tgacgccgtc atgaaaagta ggttggtacg
338501 tttttaatca caaaatagac ataatatttt gaaacctgta aataaaaata
338551 ttttacaatt ctttgaaatt aaatatttca gactgctttg ccagcaacat
338601 gctcaattcc cgatcatcgc tcaaagtggt aagtttctaa aatttagcac
338651 tgtgggtttt aaagaaaggt aaacatttat gtaacataag gaatagtcta
338701 attttctagc ctcgttgaat taaaatacaa atgtttgagt taaaatttta
338751 cacatctaga aaattgacaa cttctttgtg tactatgtga tatgactgac
338801 taattttttc ttctttatga acaagaccta ttctctttga accattccct
338851 ggtatctttc attctcccta cgctcacaga accaaactaa gacatgggaa
338901 aaagccttga cttttgggac tgcttctctt ccataagaat tttcagtaga
338951 taaaatttta aaagtgctgc accttccctg agtgaaaatt ccctaaggat
339001 gcatggttag catttcagtt ctaattaagg cagactggat cctggctaac
339051 tggagtcatg gggtatactt tcattcatga gtggaacagc agtgtcttag
339101 cagcactaca tctgcaatgt tcattgtgaa gtggagtcag gacctcgttg
339151 gaagacttcg ttctgcgtca tgccaactgc attttatggt gataacattc
```

FIG. 5 CONT'D

```
339201 tccaaatagc acctctacaa tcattttca gtcgttaccc ttttaactca
339251 gcaggaaagg ctattacaga tacttcttta aatcagtgtt tattgacagg
339301 gaaaagcacc agcaatacac acttaaccaa atccttgcaa atgtcatcta
339351 ttaaatatct tcatccttat tagtctgttt tactttgaat atcttctgag
339401 tgaaattgag tgcattccca tatcttttca ccaattatat ttgttttcct
339451 atgacccaat ttgttcattt ttctattcaa tgaaccctct ccccagagag
339501 ttccccatgt gccaattttt ctactcaatt atttacctgt tttgcattaa
339551 acttataata tcttttttaa aaattaaccc tttatcataa gtgctgcaaa
339601 cacttagttg aagtttgcca tatcttttga ctttgtaaaa acttttggca
339651 tatgagttgt atatttcatg tagtcaaaca gtaatctttt cctttatgga
339701 ttccaatttt taaatggttt atattttag ctaaattttc aggagtgaaa
339751 agaaaaagag gaaggaagaa acccctctca ggcaatcatg tacaggtaat
339801 ttgacttagt ttttatagct ttgcatttct tcatacagag tccttattta
339851 aaccagtctg aatgtcaggt gaaaggtact ttccaaatcg tccaaacaga
339901 gagcctttga agaacattct tcatttgtgt tctcagctaa ggctgctcct
339951 gaggttgcct ttttaggaag aatcccatag tcgggaagct cttagataat
340001 tcctagatga tagaatcatg atgagatgag catgaaaatg aagctggaag
340051 ttccaagcac ataaccttca ggaggtgaca ttctccgagc tcctataaat
340101 tccctggcac caaactagtg agagcatctg accccacagg tgcttacagt
340151 taaaacgggc agagggtgca gtcaaacatc cttatggagc caagtatttc
340201 ccagctgcat gacccacacc tgaccaaatc tgtagctctt ataaatttct
340251 ggattatgta taaaatgtat gaaaatattt tggggatttg agttttaca
340301 catcagcaca tataagctaa attcatatgc gccagcaacc ttcacctcct
340351 cctgtttata caaggggtgc ttgtcaaaca cctcttaatg ttttataata
340401 caaaacaaaa atatatttga tgtttacatc taaatatgaa tatggggttt
340451 ttttgttttt tttttttttt gagacagagt ctctctctgt cacccaggat
340501 ggagtgcaat ggtgtgatct aagctcactg caacctctgc ctcctggatt
340551 caagtgattc tcctgcccca gcctcctgag tagctgggat tacaggcatg
340601 caccaccacg cctggctaat ttttgtattt ttagtagcaa caaggtttca
340651 ccctgttgtc caggctggtc tcgaactcct gaccttgtga tctgcccatc
340701 ttgccctccc aaagtgctga gattacaggc gtgagcacc gcgcccagcc
340751 agggcatgat ttttactgta ggcatatcat ttagttatgc acagcaaaag
340801 actggttttc attttatgca atattaaaat caatgtaatg caatcttgat
340851 tttctctcct agccaccga aacaatgaaa tgtaatacat tcataagaca
340901 agtgaaagaa gagcatggca gacacacagg tttgcgctaa gtgttgtctg
340951 taacaaatat ggcctacaat acttataaaa atgtcaaccc acctgtttca
341001 aacttggtat cccgcctaaa tcttattct tctaggcttg tggtaattaa
341051 tgagtataaa tctttatcgc aactgtccac tctattgtaa tcccagcata
341101 tcaagataac ttaggttgga atggtccatt gcattcagta ttaagaaaag
341151 atagacttct attaataaag acacagacag gcttgcctga gctcagaatc
341201 cagcaatgtg tcacccctca cactgtgacc cctgtaactg tagttctctg
341251 ttctttaaag aaatagacat tccactaaca acacatacaa actgtgacaa
341301 gaagtgacag gggctgttat gtcaaagact taagggtaat ttttaaaaat
341351 cctcttaatt caactacata tcgggtacag tgtacactgc tcaggtgaca
341401 ggtgcaccaa catctcagaa atcaccactg aagaacttat ccatgtaacc
341451 tgaaccacc tgttccccaa aaggtattga aatttaaaaa gttacagttt
341501 tatatgttta aaaaagcctc ttaattcata tagttattgt aagcagagaa
341551 attttcattt ttacttttg taacatttta ttcattgttt cagctggcca
341601 aaaaaatga ggtatgatga aattataatt aataaaaagg gtgaaggtgc
341651 tgtattattt tactaagtat gtgcatccac cactaggcaa ggtctgaaga
341701 aataagcata aagtaattta tgattagctg ccctaagact atttccttct
341751 caaatgtttg tcttattctt agatgcaact gtgaaagttc cttttcttaa
341801 gaaatgcaag gaagcaggac ttcttaatta cttacttgaa gaaatattag
341851 acaaagttca ttcaattcca gaaaaactca tggatgagac tacttcagaa
341901 tcaggtactg atgaagagca atatttcgaa gtatagagac ttctcccaga
341951 tctagattta aaacaaaaca aacccaagaa aaaaaaaag gcccatttc
342001 ttcctatact acttttttct tctatcagct tttggaaatg cttactattt
342051 atttcacttt tggttttgc cctatagaaa ataatcccat tcaaataaac
```

FIG. 5 CONT'D

```
342101  atttttata  ttgttgccta  caatataagc  tgtccagctt  gtcattcttt
342151  acctttacct  cattctttt   tttttttta   agacggagtt  tcgcccttgt
342201  tgcccaggct  agagtgcagt  ggtgcgatct  tgcctcactg  cagcctctgc
342251  ctcccaagtt  caagcgattt  tcctgtctca  gcctcctgag  tagctgggat
342301  ttcaggcaca  cgccactacg  cctggctaat  tttctgtatt  tttagtagag
342351  acaaggtttc  accatgttgg  ccaggctggt  cttgaactcc  tgacctcagg
342401  tgatccgtcc  acctcggcct  cccaaagtgc  ttggattaca  ggcatgagcc
342451  accatgcctg  gccctttacc  tcattcttta  ataaaataat  tggaccagat
342501  ctactatcct  tcataaatca  acaggatgtg  ggtaatttac  aaactcagta
342551  atttagtcaa  aagtaacctc  atgccctgag  agttgtggta  catttttccag
342601  aggtgtctaa  caggttggcc  actaagagaa  tgtgccattc  agagattgat
342651  tcggtcacat  atgctcccct  gccaccgccc  tgcattcctg  ttgctaagat
342701  ctgagaacag  tgttatgtta  cagttttgat  tttggaatcc  aattctattc
342751  cttaataagc  caagtgtcct  tttttaaata  aggttaactc  aaactttaaa
342801  gtatagaaga  aggaatttta  atgttttgac  tgatgtttgg  tttaaagatg
342851  tactttgtta  aagaagtttc  tttcttaagg  gctctttggg  aagtcaaagt
342901  tccatttgta  tgtgcaggta  tatagctact  tagctttttg  tttgtttgtt
342951  tttgaggcag  agtctcgctc  tctctcccag  gctgaagtgc  agtggcatga
343001  tctcagctca  ttgcaacctc  tgcctccagg  gtttaagtga  ttctcttgcc
343051  ttagtctcca  gagtagctaa  gattacagac  atgtgccaac  acactcggct
343101  aatttttgta  tttttagtag  agatggagtt  tcaccatgtt  ggccaggctg
343151  gtcttgaact  cctgatctca  tgtgatctgc  ccgccttggc  ctcccaaagt
343201  gcgggggatta caggtgtgag  tcactgtgcc  cagccttact  tagctttctt
343251  ataacttata  tcccatgagt  ttaaaaccttt tattataaat  atagttattt
343301  tacaaggaca  agctggacag  cttatattgt  aggcaacaat  ataaaaatg
343351  tttatttgaa  tgggattatt  ttctataggg  caaaaccaaa  aagtgaaata
343401  aatagtaagc  atttccaaaa  gctcatttat  tatactattt  tattcattta
343451  tttcctctag  accaagcact  tcccaaacag  tgtgcctgag  aaccacctgt
343501  agggctggtg  aggacacaga  tagctgggcc  tatcccacag  agattctgat
343551  tcagtacaaa  taccaagaat  tgggggccag  gcgcggtggc  tcacgcctgt
343601  aatcccagca  ctttgggagc  ccgaggtgag  tggatcatct  gtggtcagca
343651  gttcgagacc  agcctggcca  acatggcaaa  accctgtctc  tactaaaaat
343701  acaaaaatta  gccgggcgtg  gcggtgcgcg  cctgcaatcc  caactacttg
343751  ggaggctgag  acatgagaat  cgcttgaacc  caggaggcag  aggttgcagt
343801  gagccaagat  cgcaccactg  cactccagtc  tgggcaacag  ggtgagattc
343851  tgtctcaaaa  aaaaaaaaaa  aaaaaaaaga  aaaaagagaa  atgccaagaa
343901  ttacatttct  gacagcttcc  ctgtagtgct  gctgctgctg  ttgccatcta
343951  acattaaagt  tccatggcac  atgactgctc  tcttttccttt  ccctgtttt
344001  ggattacata  tataaatgga  ggagtttctg  cctatacaaa  ctgtttaata
344051  ttgaaaatgt  ttctctccct  ccagactatg  aagaaatcgg  gagtgcactt
344101  tttgactgta  gattgttcga  agacacattt  gtaaattttc  aagcaggtat
344151  atgagttata  taacatctga  gcagcatagt  tttgagaaat  atttatcacg
344201  atattgaaac  aatatactgt  acaggtgata  aaaatatttt  agaagaatgt
344251  tcattgtttt  cttaaatgag  aaaagccaat  tacaaaaaca  gtatgacccc
344301  gcccacctgc  ccacacacac  aggaaaaaaa  tatcgaggta  catgtgcaca
344351  gacaaaagct  gcacctggtg  gagacagtag  ttggttgtag  gtagttggaa
344401  tatagtgatt  tttgtctgtt  cttttactgc  tatattttcc  agatttctta
344451  tatacacaca  aatactttta  taatgagaaa  aactcattaa  aaaagtagag
344501  acaacaaaaa  attgattcaa  aaattggagc  atattttggc  ctgtgtgtgg
344551  cccaggcagg  agctggtaaa  gcttcctgcg  gcttctctgc  tcttgggtgg
344601  cgaggctatg  ataaaccatc  cctccgcttg  cctccctctc  gcttggtgag
344651  ataggtcaaa  attttaattc  tcccactatt  aatcctcaaa  tctaatttaa
344701  tttcttatca  gggagggtta  cgactgattt  aaagttcatc  agaaaaaaaa
344751  aaaacaaaaa  caaacaaaca  aaaatgagc   aagtaagaat  agccaagaaa
344801  tgtttgcagt  agaaaatctc  gtttggtttg  gaggagggag  atttaacctt
344851  cctattaaat  atcaaccatt  tattgagtga  gtcctccttt  cagcattaag
344901  atgccctcaa  gacaggctac  acctccactt  gtttatgagt  ctggtctgac
344951  ttctctatca  aggctgccac  acacagctgg  gcaggccggg  cacagagtca
```

FIG. 5 CONT'D

```
345001 aacagcattg gtggatggct cccctgaag ttgcacaaca gagtgagtgc
345051 cctccacact ctgcatttcc acagatgcat ctgtctctcc agcatatggt
345101 aggaagacaa taagatttcc ctgtgaagaa atcattagtt catatccctg
345151 tctcaacata cacaacctt ctcattttgg cttctatatt atacatttct
345201 atttgaattt tttactacat ttataaccag caggaaaaat actttgaaaa
345251 atctaccaaa aagagtgtct gtcttaatag tcttttgagg atgtctgcta
345301 atatatagca gtatccatat ttttttaaag cagccttaaa aatttttttc
345351 taaaaagagt tattttgtag gggacttcca tgtgtgtttt tctttcatgt
345401 aagggaacat gtcacacatc actacttgga tggattaggt gggagtacat
345451 atattatagt gtagtatggc ggggtgcca ctacttagaa ctgcatgaga
345501 ttcaacttaa aaggcttaag ttgggtttca ctaccctggt tgataaaaac
345551 ttgcttaatt tagccttact catatttaa gttaactata cgtatgcagt
345601 tattctgaat aaagtttgta tatgtgtgta actgttcgat tttgaggctt
345651 ttaaaaatta cattgccatt gactactatt tgttatttat aaagcctaag
345701 tatcttcctc ctaagctttt ctaagtttcc acaattaaaa gccttcctat
345751 ttctaaatga aaccaaaagc ctttatgtaa cattaaaaat tggacacatt
345801 tttaggaagg atttgtcctt aaccttggta ttctagccac attctccaat
345851 tatcatctct caataaatgg atatagtata gcatgaaggt tatacagtca
345901 ctgttttcaa gttctcaaag atatacaaag ggacttgttc tgctataaat
345951 gtgcacaaaa tcttaagggt ttactgaaca gctttgtgta tgataaatgt
346001 tagaattctg tcctgaatta gaaggaggaa gtgaaggcat aaagaaacca
346051 gctcctgccc ataaggctct ggatccttt caccagaggc acgaggattg
346101 tgtatctgta cctgcaagtg aaaggggcta gaaatggtac attatttcta
346151 ataaaactac tgaataagct gaaataattt tatttcttct tttcatagca
346201 atagagaaaa aaattcatgc atctcaacaa aggtggcagc agttgaagga
346251 agagattgag ctacttcagg acttaaaaca aaccttgtgc tcttttcaag
346301 aaaatagaga tcttatgtca agttctacat caatatcatc cctgtcttat
346351 tagggattac cgtttcctaa gccaagagtc atgtcaaatt gcaatcaggc
346401 tcaaaaccag agaccaggct gtgaaatcca cacatcttta gaactagtcg
346451 tctcctcttg gcctcagcag ctcttccctg ttcttactgg ttgacatttt
346501 gatcactctt tgcacactct tgtgttttt gctcactgtc acattcccag
346551 cacctagtat gctcagtaaa tgtttgtgga ataagtgcat aaaatgttct
346601 taacctttga ttctacttac agcccatgat agcctcttag atataataaa
346651 tttggattat actactttac ttgtaccaaa tttgcctgtt ttcgtgtcac
346701 aaagtctgct tttgaaaagt ctcttttcag ccacagttat cacgtggaga
346751 ttcatcatct tcaaaacaga cacctaaatt ttaaattgga ctctgaataa
346801 gaacattatc gggagtatgc aagaatgaaa aaaaaaattg acagttacat
346851 ttttctcaat ctaatatacg attctggttt ttatgcccac actatcacgt
346901 ctgacccctg aaaacttaac attcacagtt ctcattttt accatggtac
346951 tctgattttc aataatgctg cgtctcaaaa tgggttttaa ctgagtctcc
347001 aagcatggtg tctgacatgt aataaataag tactggaaaa atatttgcag
347051 gagatgaaaa agaacagtcc attccagttg taatggcagc cctagcctaa
347101 gttcttatat cttagggaca aaatctaaac cagtggattt caaatccggc
347151 cgcacatcag aatcatgtgg ggcactttaa aaactacaga agtgaagacc
347201 ccatccaaca ccctctgaac agatttccgc tagtctagat gattattgat
347251 tactgtagct tcagcttcct atcctgatat taagtcttag caaagttttt
347301 ggttgttgtt ttgttttgtt taagacggag tctcactttg ttgccaggct
347351 ggagtgcagt ggtgtgatct cggctcactg caacctctgc ctcctaggtt
347401 caagcgattc tcctgcctca gcctcccaag tagctgggac tacaggcgcg
347451 caccaccatg cccagctaat ttttgtattt ttagtagaga tgggggtttca
347501 ccatgttggc caggatggtc tcgatctctt gacctcgtga tctgcctgcc
347551 tcggcctccc aaagtgctgg gattacaggc gtgagccacc acgcccagcc
347601 atcttagcaa agtttatctg actaatcatt ctgatgtcat gatctttatt
347651 taaaaaaaaa aacctttgtc ccccacttta ctttcacgtt taacctgtga
347701 ctcacacagc atgtaactgt gcaccatgga gcaccatgtg tttggtggcc
347751 atgaggctgg ctactgggca aacccgagta tgggttcata aggcggagcc
347801 gagtatgaac ttcagctatg tcactactga aaaacttgaa tccgattatt
347851 taatctgaga atgctgctgc ctaccttatg ggacaaaata tggacaagta
```

FIG. 5 CONT'D

```
347901 agtaaaatgt gaagcagaga gcacaatgtc tggcactatg ggaaataaat
347951 gttaaaacac acccatgcac gcacacactc cccttgctaa catttctgtc
348001 ttattttctc cattctaacc aaacttaatt atgataagct ctggaaggct
348051 cattagcccc catctcttgt gcctcttttt gtttggaga tgagctaaaa
348101 ggacacttta tattttcccc tatccaacac aagcgttatc ttcagaacaa
348151 ctaactgctt gtcatgttaa ccctattaac tgtattagtc cgttctcaca
348201 ctggtatgaa gaaataccag agactgggta atttataaag gaaacaggtt
348251 taatggactc agttccgcat ggctggggag gtctcaagaa acttacaatt
348301 gtggcggaaa gggaagaggc ccgtcttacg tagtggcaag taagtgagag
348351 cacgcaaagc ccagggggaa ctgccattta taaaaccatc agatctcata
348401 agaactccct caatagcatg agaacagcat ggggaaaccg cccccataat
348451 ccaatcacct cccaacaggt ctccctcaac aactgaggat tacaattcaa
348501 gataagttgg gtggggacac agagccaaac cacatcatcc tatttggttt
348551 tctctcactg actgttatga aaagctcttt ataagtatct cattgtgttg
348601 ttaattccta aacctatctc cctctctcct aataattcat atgttctttg
348651 aggataggga atatgccttt cccttcaagt acccccaaag gtacagacac
348701 attttctac tgtgccagtt caactgtact acccttcagc aggaataaaa
348751 tccaaagatt tctatgatgt ttgtttgtgt atagttgaga atcaagcagt
348801 tgacatgttc atgctggtac ctatttttag cctgatacccc attaagaatc
348851 acaccactga ttttttttat tatggtaaaa tatatatata acctaaaatt
348901 tgccatccca atcatttta aatgtatggt tcaatggcat taaacattca
348951 ttttttgtgca accatcacca ccatgcacct aaagcagcag tccccaacct
349001 ttttggcacc agggactggt ttcgtggaag acaattttc cacggaccat
349051 ggggatgggg cggttggtca ggggtgggga ggatggtttt gggatgaaat
349101 tggtccacct cagatcacca gtcattagat tctcatatgg agcacacaac
349151 ctagatccct tgcatactca gttcactgta gggtttgcac tcctatgaga
349201 atctaatgtt ctaatgttgc cactgatctg acaggaggca gaactcaggc
349251 agtaatgctc actcatccgc cactcacctc ccgctgtgcg acctcttcct
349301 aacacgccag ggatgaatat gggtctgtgg cccgagggtt ggggacccct
349351 gacctaaagg actcttcatc ttggaaaact gaaactctgt atccattaaa
349401 caagttcccc attctcctct cccctcagac cctggcaatg accattctac
349451 tatgtctcaa tgaatttgac taagtatatc acacaaatgg catcacatag
349501 tattttctg tgagtggctt atttcaccca gcataatatc ctcaagttca
349551 cctctgtgca ccatgtgtca gaatttcttt ccttttaag gctgcagact
349601 actgattttg aaggaaaaaa acaactctat gtgcctgttt taatgttact
349651 ttgtttatta acatgtcgtt ctaaatatta cataaataca gcttacatac
349701 tagagtatca aacattgttc cagtaagaag ttcaagagta catttagggc
349751 tatcttaaga aatatgaata ctttggcttc cattattaca ttagatgaaa
349801 aaatcaattc aaataagagt tgtcatatcc tgctatgatt aacaaaaaaa
349851 caagtagaaa aataagagag tgtatttaaa aaaataatc aaatgctttt
349901 tgaaagacct gttctcttca ctgccacaca tattcataca aatgacttag
349951 taatctaata tgagaagtgg tccttcactt atattaggaa cttggtaaat
350001 atttgttgaa tgaatgaact atctatggat atgaatttac tactttaatt
350051 tgtgcttttt ttgaaaaaaa gttttcaagt aagagcaata gtaaacatac
350101 tgaagttcac attttgctca gatcataagc ctatagaaca gtgattgtta
350151 caaacaccac ccatcatagc acaaatcaat gtgcatttct gaagctagta
350201 agaaaagttc tatcatgttg tagaacgaat ctaaccgac taattcactg
350251 ggcttcaatc acttgtgata tggtcaagaa aaggggctg gggctcctag
350301 gcttgtatct atttcagcta tcagtgaatt cctatcttta gggcctcact
350351 cccccttccca ccccaataga cacaaattta aaaacattgc taaaaatagt
350401 agttgtagca tgtcttcacc cacttgtaat ttggctctga aaatgtattc
350451 aggctccagg ttcagaagag agactttcca agcaggagac aaaattcact
350501 aagggaactc actcaaatgg aaatgagttc atggaccaga gagcaaagca
350551 aaacattgct cttaaaagca agctcaacgg acacacatga tgaaactcac
350601 agttgaacac tcttacatcc caaagtcacc ttccataacc agttcaaata
350651 aactactgtc ttttaatagg atcttttcag gaacaccata attttggtgc
350701 ttttttcaagg tgaaattgtg ctgttatacc taagatgttt aaaaacagag
350751 gaaaaccaaa agtgaaagat gataaagttt cacataagcc aatgtgtgat
```

FIG. 5 CONT'D

```
350801 ggatttggcc taaagtagat aaagcaaatt ccactaagtc ttgtaagagg
350851 gttgacttga agaaccactt cttccagtca tatatagtag atatgatgat
350901 tcagcagtca taatttagga aggcaagagt atactataca tgtcattatt
350951 ttcctcttaa gtttgcattt atagaagaag gtggtggggg acaatttaaa
351001 cttgagttct caagttctac cttaatgaaa taaaacacca ttggataagt
351051 agtggagatt ctaatttata aaatattcac cttcatcaaa tttctttcat
351101 tatcaacttt tcacggatac ttctaaatta ctattcttta tgcacttaaa
351151 tcttaagaga aatcttgact aacctagaat atttatcttt acataattat
351201 catttcaaca ggtttaatat acgttaaact tattactttg atttatcttg
351251 aagttaaaaa agtcatcaac gcaagcacac aaacaaaagt ctgaaacaat
351301 cttaattatt ccttcacagt aaggctacta aactagcaac taaggcagca
351351 cttaacaatc cccaggtcag catctttaat tcacgatggg gcctctccat
351401 tcatctcaca attccccaac tatcactgct cctgctgtca gaagattgtt
351451 gatacgtggc ccaggagagt tgctgccaac ttccccttc caagttcaga
351501 agttcctcta atcaaaaatg aaaagaagac caaaaacgac taactttcac
351551 ccttttacat gttccagccc aaatttacga aaggtcacat ttaaaataca
351601 cttatctgga acaagggtt gtttaaaatg ggctcaagaa aagccgtaca
351651 cccttgttat gttcctacac aaacaactgt gtcccagatg tggaaaaaaa
351701 caacctgatg gtcttttacc tgcagaatca catcacccgt agagcacaaa
351751 ctggacacat cctcaacagt gccccagagc actcacacag aacccagcag
351801 ccttgcgctt cagttcttaa aggctccaca tttactggct ttagcaatga
351851 attccttag cagagggcca tccatttgcc aaaatgctgc agtctgtgta
351901 acttctgtca aatgattgat gcaaaactta aagcagaatt cttctaaatc
351951 ctggacacac aacaaaaata aaaacaaaaa tggctttttt aggcaacttt
352001 gattgaatta cttctctctg agcccttac cccaaatctc tcaccctccc
352051 ccagaaaaga tatttgagag gccagatacc taaaactagg caaaaaggtg
352101 accacaggta ggtgtgagaa aaacacatac tatttattca acgcagtaaa
352151 agcaatggtc ctctaactca aagtacgact cttcaaaaca cacacgcgcg
352201 cgcacacaca cacacacgca agatctacaa gggaaagaat ttcctgcacg
352251 attatcacat aatctagtta tgctcaaaga cattgttgta aaaggcagaa
352301 tgccacttta gtctgcagaa tgtgttttgt cacgttcaag acatcagaga
352351 aaagaattaa gatgtgggtt agtttaagaa acagaaaggt aatgaagaga
352401 tatggtcaac ctaaagtggc acattaaaaa gaaaatccca gccgggcacg
352451 gtggctcacg cctgtaatcc cagcactttg ggaggccgag gcgggcggat
352501 cacttgaggt caggagttcg agaccagcct ggccaacata gggaaacccc
352551 gtctctagta aaactacaaa aattagccgg gcgtggtggt ggatgcctgt
352601 aatcccagct actcaggaga ctgagacagg agaatcgttt gagcctggga
352651 ggcagaggtt gcggtgagcc gagatcgcac cactgcactc tagcctgggt
352701 gacagagcag aggctctgaa agaaaatccc aaaaaattca ccttaaattc
352751 acttttatgc tctcctaata atgactttat ttttaaagcc ataaagaata
352801 ataacactac aacttccacc acactaatat ctcagaacat cacccccaca
352851 gaagtatatt tacacaggtt agttttcagt caaacagaag tcaccaacta
352901 ccaacattca ggggagtaac atccacaagg ggtaaaccag aaccatttca
352951 aaatcaatcc ctgcctatgc taatccaccc tttcatcccc tgccaaactt
353001 taatatagtc tgtcccttag gatgttggaa tatatattta ttaaatcgat
353051 taggcacctg gaatgcatac aaagactcaa tatataaaag gaaatcacac
353101 taaaagctct tatcacaaat agcttgactt tattacaact tggttagctg
353151 gtacattgaa ggtcagcact ccgggttcta tcgaaccaga agctcaacat
353201 ttcaactgca ggttttgacc gcacatttcc agctaccacg aggtgggaat
353251 gttagacaga gtggaagggg cccacacaaa catggagaga ccccttttct
353301 gctctcagca cagacctctg caaacaatga tttccttgtt ctaagggtcc
353351 tcctgtccct ggctaaaaga tgccctagag taaactccag aaacccatcc
353401 agtcacataa ccattaagag ataaaccaca ggccaggcgt ggtggctcac
353451 gcctgtaatc tcagcacttt gggaggctga tgcgggcaga tcacgaggtc
353501 aggagtttga gaccagcttg accaacatgg tgaaaccccg tctctactaa
353551 aaatacaaaa attagccagg tgtggtggca agcacctgta atcccagcta
353601 ctcaggaagc tgaggcagga gaatcgcttg aacccaggag gcggaggttg
353651 cagtgagccg agatcatgcc actgcactcc agcctgggag acaggagtga
```

FIG. 5 CONT'D

```
353701 aactccatct caaaaaaaaa aaaaaagaac ttttatacac aatataggta
353751 taaaaatggt gccactaatc acaattcact ttatacactc atgaaaatgg
353801 ttctatcaaa ctgccttccc ttcccctcca attagtttga actactgagg
353851 tatctgggta tgcaataaat attcaaaagt tccaaacatt aaaagccaaa
353901 ctagagaatt ctgaaaacaa tctaaatctg ggttgtgtaa gtaactaatt
353951 aaaccttggt tgaggcagat ctatgtaaaa ggaagccctg aacgcatgtg
354001 gtgagggacg tttgaatttg caagttcacc agagagtcgc acagtcaagc
354051 tgaaccactt agcaaccagt gcccagggtt ggtttgcctt tgatgagcaa
354101 gttagacaaa cgcccttccg acttgacctc tctttagtat tataagaatc
354151 tacataatct gttcctttca ttctgcaaag gatcaaatct tcaataacag
354201 gcaagaaaat gcaactcctg tccaagtgag aagtcaacta taacagggct
354251 ggttatagtt gacttcttac ttctaactgg gctttaaata aaacagttcc
354301 aaggaggacc agaaggatca tgtgaccagg agatgaacaa agttcccgac
354351 agaatgaaag tcctcttata gcccatggaa tagggaagtg gagagtataa
354401 aaacagaagg gtctaataca gtcttcttgg tattagaaac taaactctgt
354451 ttatgacgtt atgtggcaga acaattataa agtgttctaa ggcaaatgag
354501 ataaaatacc agatttattg tcattagcaa agaagacaaa aataaaaact
354551 gctcttctga agtaatttat aaatcattcc aaatctttca acattgaaac
354601 tattccaatt caatatatat actctgaaaa taagctgttt ttcctttcca
354651 caaattttct ttagtaacaa aacaaaacac agagcattga tggtcttaat
354701 atcctcattt taaaaatgc taatgccgcc tctaagggag ttcttaccct
354751 gtcctaaaac tccaaagcta aactagttga atgttaataa tttgaagacc
354801 acctaaccag ggtgagcagg tgcctcggca tcacagctcc ccacaagaca
354851 cattccagat gacacaagat cacgaaccac acctaactct gtccaacctg
354901 ttgttaaagt aactgcaaga caaaacccca aaactgtcag tctataattc
354951 atgttatagc acatcaagta caaaatattc caaatcaaag aagttttgtt
355001 ttgttctcaa aatgtactta aacattctac catatggaga aaacataatt
355051 tatcccatta cgcaaaaaac atttgtcagc ctactgctga tcaaagactt
355101 ttcatttggc ccaccaaaag aagaaaaaaa cgctggccac caagccttaa
355151 caccaagctg tccaatactc atacccagga ccaacttcag aattagattc
355201 ctgggctcac gtttatcgct tccctccaaa agcaagatcg taagatataa
355251 gttgcttagc acacaggatt tctggaaagt tctctactct ggttaaacaa
355301 ataatacttc ccagctgttt ctcttaacgt tcaaatacac ataaaaataa
355351 aaaatttcct gaaaagaatc agtttgcatt gtgcaactga tctatcttga
355401 aacaatgttt tatccacatt ttctccctga tgtcaatatt tattcaggtc
355451 tgtaccaaag gagtatctgg gtgctccttt gtgaagtcct tcttaataaa
355501 acttgtggac agtttcataa cacgttcata gcaagggatc cacaatcatc
355551 aacttacttt tgaaactccc tgtaactact gagtccatac attttgttg
355601 ctttaatgtg tgtacatttg cttcaaagct atcttgtcaa aacgggcat
355651 ggaggaacct caggtacttt cgtagaaaga caagaaacat tggaagcagg
355701 tagtctccat cttcctagca ttttggccca cagcacgaag gcaaagtcat
355751 ctagcatccc caagttgagc tctaaaaata atagttttg cagtcaattt
355801 ctaacctgac tcatcagtag cctccaatca actaataaac acagtaagag
355851 ggctttcttt ttaagagatg gcagtctcac tatgttgtcc aggctggtct
355901 caaactccta gcctcaagca atcctcccac ttcagcatcc tgagtagcta
355951 gaatacaggc atgagccact gtgcccagct atggatttta attttgtact
356001 ccagaacttc attcatgtac tcactgtatc ttgtagcatt caggaaataa
356051 aatgtaaaag cacattagtc aattacgtaa cttgtattgt aacctaagaa
356101 atacccccta gaaagaggcc tggcgcagtg gctcatgcct ataatcccag
356151 cacttggaa ggctgaggtg ggagggacac ttgagcccag aagttcaaga
356201 ccagcctggg caacataatg aaaccctgtc tctacaacaa ataaaaaata
356251 agaaattagc tgggtgtggt ggcacacatc cgtagtccca gttcctggac
356301 tgggaaggaa ggaggactac ttgagcccag gaagttgagg ctacagtgag
356351 ctgtgatcac accactgtgc ttcagcctgg gcaacagaac aagaccctgt
356401 atcaccagga aaaaaaata catacaaatt atgaatatat atatatacac
356451 acacacacac atatatatat atgccctaga aataaagagg tgagtctttc
356501 tttttgtctt ctttctattc tctaatttt ctacgttgaa tctgtaatat
356551 ttgtaggatt ttaagttttt tttaactttt ttttttttt tgagacagag
```

FIG. 5 CONT'D

```
356601 tcttgctctg ttgcccaggc tggagtgcag tggtacaact tctccctccc
356651 agattcaagc aattctcctg cctcagcctc ccgaatagct gggattacag
356701 gtacgcacca ccacacccag ctaatttttg tattttagt agagacaggg
356751 tttcaccatg ttggccaggc tggtctcaaa ctcctgatct caagtggccc
356801 accttggcct cccaaagtgc cgggattaca ggcgtgatct ccaagcctgg
356851 ccatttttt tttttaagc acaccttcat ggtgaggtat ttcaaatgtt
356901 ttcactcatt tatttaattc aacatgcatt tttgagcgcc agctccatgc
356951 ccacactgtg acagactctg gggaatcaca cttatttgga gtctttctaa
357001 aggaagtttt tatcatgttt atacttaata tgagaaaaat gaaaactagt
357051 aaaggaaatg acctgctggc acaggaagca gcagcagagg ctttttctgt
357101 aaacttccta ggacagatct tagctaaaag tgaggaagaa gtttccagca
357151 acttgagccg agacatctgc ctctgcccag gttgttctca ctggtgttag
357201 tcagcaaggt ctgatcctga gtatggaact cgttaacaag gaggaggagc
357251 gtggagaggc ccagagagga ttctaacatc cgtcaccaaa tggacagaaa
357301 aggcactaac ccaatttaaa attatatcac cgggtggaaa taaaatctaa
357351 agaaacagct tttctaataa agaggttcag ggtgtcacag gaaggacagg
357401 aaaaaaatca taccccattt tctattagaa atgatttact ttgatcatca
357451 ttccatctgt tgtcgggctg cagacaaagt cagctacatt tgaccttatc
357501 aaatatttat aatcagaata tagcctcaaa caaaaataag atacattttg
357551 aaaacatcgt ggtcaacttt gatccctatg tgtgatgaag tgtgtcctct
357601 tatacctcaa aggacacagc tgcagatctt tgcaggtgtt tgataaactc
357651 cttgatacca gatattctgc tttgtcaaat gacaaagtat ctgcaaggat
357701 aggctaattg taacattcta catgcacaac ttagctagat attttgaaac
357751 tccaaggcta ttgctctcta cctttttattc tctctgaatc tgtgaaacca
357801 accatacccg ccttcagctc actgatcatc cttaatgctt cctttaaggt
357851 actatcttca tccagttcaa catttatcag gtgcctaata tgtgccaggc
357901 actataggt atacagacga atgagacagt tcctgctcac gaggagctta
357951 cagtctgatg ctttggttct tcaaaaaaat gcacacaaac tttcagactc
358001 cccaaagccc attaattcac aggctcaaca gatctgtgaa tctcagatta
358051 agaactcaac ccagtgcaaa aacaaaagga gtccacagca agttcttaac
358101 aggtaaataa ctgtgagctg taattagaca ctaatagaat tgcagagcgt
358151 acacagatac aaatcataca catccccagc ttatgacagg gcagaggtgg
358201 aaagacagca aggtaagtct cgaaataaac acatatgctg acattaagaa
358251 agacttgaaa ctaaatatg ctgtttgtta gtccaattag ttgtggcacc
358301 ttatgttcca acctgcagca cagctgctag gaccttggtt cgtttcctgt
358351 cttacttaga aatgaaagta gaggaacaac gacttttgaa acaatgaaca
358401 gggaattaag aagcaagggc agatttcagt tttcaatggg ttcactgatt
358451 ccctaaacag aagtggagtg actcatcgtt ttccatgcct cacgcaagaa
358501 gcgggggaga cgagcacaaa gggagttaaa ggtggtctgg tttctgtttg
358551 ttgtttaagt tacctctgca tcatatctga ctgcagcaga gaatagcgaa
358601 aaggcattct ccacagtaat tcctctcttg ataatgtgct gacaaagttt
358651 tttcagtctg ttttcacagt aagatgtcgc caaatccaga agacctaaaa
358701 gtaaaatatg tgaaaggttt aatcaaatgt ataataattt ccaatacaca
358751 gagattttgt tttggtgaac agaggtgtac aggtaaatta gaagtttctt
358801 agtggataag attctgaatt tgagtaaata aattctcttt tttactgtct
358851 gcctcctcca cttccacacc tctcctatat ttactttata caatttcttc
358901 aatagtgcaa agaaagagca aaaaatgcaa tttcaatcct catttgttt
358951 ctaaaacgct aaatgcatta gcaacttata cttcactact agaaaattaa
359001 aataagccca tagcttaata cctaggtgat gggttgacag gtacagcaaa
359051 ccaccatggc acacgtttac ctatgtaaca agcctacaca tcctgcacgt
359101 gtaccccaga acttaaaaat aaattaaaaa aaaaaaagtc cttcagtaac
359151 attagaacaa aaaagcctat ggtcataaac taggtccaaa actattaacc
359201 ataataacta cacaatacta cttttaaaga tacttacttc aaatcttttt
359251 taagcaccaa attaaagcca atacacctga agctttttac atttcaggac
359301 taagaatatg aggggatata ttctccacca tgcggctcgt ccatcccaat
359351 gctaccacag tacctatagc atcttctggc ggcaggtcga ctgtgtctgt
359401 gtagaggtac tggagaaagg cacgatacac tgggtaagaa aactgatcga
359451 tttctatcac ttccttcatg tcttcattcc aatacgactg gaacatggat
```

FIG. 5 CONT'D

```
359501 cgaaaatgct cacacctaaa acagcaaagc aaaagtctta tttgttcagc
359551 agcaattttt aaaaaagaaa aaaaaattac ctaattaagt tgataaaatc
359601 agataaacag aagtatcctt gggccgggcg tggtggctca tgcctgtaat
359651 cccagcactt tgggaggcca agcgggtaga tcacctgaga tcaggagttc
359701 gagaccagcc tgaccaacat ggataaaccc cgtctctact aaaaatacaa
359751 aattagctgg gcatggtggt gcatgcctat aatcccagct actcaggagg
359801 ctgaggcagg agaatcgctt gaacccggga ggtggaggtt gtggcgagcc
359851 gagattgcgc ttctgcactc tagcctggca acaagagcaa aactccgtct
359901 caaaaaaaaa aaaaagtaa gtatattaac tactatctgg gcctgaacac
359951 accaggatca cagacccttta gttagcaccc aaaaaacatt ccacatgcaa
360001 gtggttttg tacatgcctt ttacatacac tcactttcat ttttgtaac
360051 tcctattaaa tactaatagg tatacataga gcctggaagt acctagcact
360101 tccactactg tttccatttg atggtcccca agattttttt gctcctttgt
360151 ttttttaaa atgatgtaca gaaatgcatt ttaaacaata aagtgaaaga
360201 aattcagaaa caagagttca aaactttga ctatgtatca acattaaaat
360251 gattcatttg tttttgttt tacataataa gcatattctt aaaactgttt
360301 tatatgttaa ctggattaca tcaagctgat tattgtctga ttatccgaca
360351 attttttcttc ttttctgact tatcgtcaaa acagccatca ctcctttttt
360401 ttttttgcat tgcctgttcc ccttcctctc ttcccaggcc tgctacaagc
360451 ttatttataa aacactcaca tccactagga tagtcagata tttcaagaaa
360501 acctgagcag ctcctacact gtatttacat gtacaaagcc acctgcacaa
360551 gaaactgatt tctgaatatt ggattttctt atgtataaca cagttgtatc
360601 tttctaaaaa tcatatttt aaattatttt aaagtgagat acggcacaaa
360651 gagaaaaagt attctgaggt gcagtggctc aagcctgtaa ttccagcact
360701 ttgggaggcc gaggcaggtc agcctcaatc acctgaggtc aggagtttga
360751 gaccggcctg gccaacatgg cgaaactttg tctctactta aaatacaaaa
360801 attagctggg cgtggttagt gcacgattgt aatcccagct acttgggagg
360851 ctgaagctgg aagatcgctt gaacacagga ggtggaggtt gcagtgagct
360901 ggtattacgc cactgcactc tagcctgggt gacagaatga gtctctgtct
360951 caaaaaaaaa agaaaaagaa tccattcaga atactaaaaa aatagtttca
361001 cttacataaa aaattacctg agaaataaaa aagaaatagt tgtctaagaa
361051 agaatcatgg atttcatggt cagaaaactg tacatgaaag gaatagactg
361101 gttgaccaca ggtgcacaga cagaaacagt tccagttcat cttttcaatt
361151 aatactgtgg ttcagatatt tactcccta ggtaaggaat gacatagggc
361201 ttttctgttc ctttcaaatg tatttctttg ccaataggtt tttacctaaa
361251 ttccaaaaaa gacttgtaaa tggccacttt aatggtctta gcttatgtgc
361301 ctttttctgc aatggcaacc tttgtggcaa acagttacta ataaacgcat
361351 aggtccctca catttataca aggaactata tcttaaaaac tttttttttc
361401 attttgaga taagatctca ctctgtctcc caggatgatc acagctcacc
361451 acagccttga tctactgggc tcaagcaatc cttccacctc agcctccaga
361501 gcagctggaa ctacaggaat gcaccaccac acctggctaa ttttttctat
361551 tttttgtaga gacagtgtct cgctatattg cctaggctgg tctcagactc
361601 ctaggatcaa gtgatattcc cgccttggcc tcccaaagtc ctaggattac
361651 aggcatgagc caccatgctg agcctagaac attcttcaat tggtaattgc
361701 atgtccctta gaaacagaag cacagcattc ctatgagagt tttctgctta
361751 atctataatt aaaagagggc atatacactt tcaataaca accttttgta
361801 ttttctttaa ccacgtaaat aaattttctg atggaaatga gtattcacca
361851 gattcttaat ttaaaaaaca atataagctg ggcgtggtag ctcacatctg
361901 taatgccagc actttgggag gctgaggcgg gcagatcacc tgagatcggg
361951 agttcgagac caacctgacc aacatggaga accccatct ctattataaa
362001 tacaaaatta gccaggcatg gtggcgcctg cctgtaatcc cagctactca
362051 ggagctgag gcaggagaat cacttaaacc cgggaggcag aggttgcggt
362101 gagctgagat cgtgccactg cactccagcc tgagcaacaa gagtgaaact
362151 ctgtctcaaa gaaacaaaca aacaaacaaa caaacaaaca caaaaaacca
362201 atatggacaa atacttaaat tcctacatta cacttttttct aaaacgctcc
362251 atgagtgtac acaaaaaact ctttgacatg aaatggactg atactatctg
362301 caaaaatatt aagtagtgac atttctctct actaccaagg ctatttttta
362351 tcagtactca ttttgtggaa taacaaagaa agaaaagtca agttattgat
```

FIG. 5 CONT'D

```
362401 gtctctgagc tcatgcaaaa atacctgatt ttcaaaacag ctttatggac
362451 atgaatatat tttccatcaa ttcgaaactt cagatcagca gtttctggac
362501 tatcaaattc tttcttcagt gactctgcaa ctgttaaaaa gtcttcatgc
362551 tctgaaggca acaaacatat attaatatgg caagttcaag aacagattg
362601 aagattcaaa agacttcaaa aagatcatca tgaccgtgat ggataattcc
362651 acttgttttt ttttcaagag ttcatacctt gtttgacaaa tcaattctac
362701 ggtattaaag taagtatcct gcatctataa actaccaaag aaaaccacca
362751 aaagatggta tttagaaagg ctaaatacca tcttatatgc ctagttatac
362801 attagaaatg tatattttta aagaaaaaaa ttataggtac ttcatgataa
362851 tataataacc ccctctcaaa acgagtggtt ctcttctaag actaagaatt
362901 tgtttccctt gactgaaaca ctaagaatat cttttttctg ctttggggta
362951 ctttcaaggg gtcagcatac ccaactcaag gaggtgcaag aaacaaactt
363001 accacttaaa tggtaatgct aagcggtcat gttctcaagc agagaaactc
363051 tttcctaagt atctggaatc taaacatctc tgttaaccct aaaaatcact
363101 atatgcataa tccttactca ctgtctaaac acagagcaaa ttcacttaga
363151 aacaacacct acatgaaggg aacagtttta taagaacaca ggatcacctt
363201 acctgataag aagaattgct gttgtggtta tatgttaagt agaactgtgt
363251 tactacaagg aaaagtaaag gcacttgtac aaattcccgg aatgctttct
363301 tgtgttttat atgtatgaaa gaagaaaaga agcagaaaag ggctaatggg
363351 gaaatttttt taaattccag agatcctgac caggcatcga atcaagctgc
363401 tatggataca cgaagcaggt ttcaactgcc cacagctgag ttaataatca
363451 gtgtcttaat caaagacctc ggcttccaag cctgggatga accatttttcc
363501 cttggtagcg tgctgttacc agagcaactc ctagaggagg gacaacagct
363551 aaaacctagg ctgaaactca acaaatgagc ttatctgcaa gctttatcat
363601 cagactctcc cccaaggcat tacctttcac ctaagccctg tgaccttaac
363651 tgacagccct ccctccaccc catgcaatgc agagctctcc tggctacaga
363701 ggaaggtag aaaacctctc aaaagtcagg cttcccctga ccttgcaacc
363751 tggatcactg gtgggtaaaa gaatacaaat gactaagatg ggccaagagt
363801 ccaggagtct agattgctac ccccacccat ccaaaaaaaa acccacttct
363851 catcagtgct tcaacttctg catccagtct taggctgaaa tgactctttc
363901 tcctcttttgc tcctggcaac aagtatagta catcctttca gagaagaaat
363951 cctcctcaaa ggggtgaatt caccatgtga ctttccgtct aacactcaga
364001 tgagatcaca aagtgagagg gaaaaaacac ttttgacttt cagtgggtgg
364051 aagggaaaga agttatctag gacagcagtc cccaacccttt ttggtaccag
364101 ggaccagttt tgtggaagac aattttttcca cggaccgagg cggggaggag
364151 gatggtttgg ggatgattca agcacattat gtttattgtg cacttaattt
364201 ttattattgt tacactgtaa tatgtaatga ataattaca caactcacca
364251 taatgtagaa tcagtgggag tcctgagctt gttttcctac aactggacgg
364301 ccccatctgg gggtgatggg agacagtgac agatcatcta ggcattagat
364351 tctcataagg agctcgcaac ctgtatccct cgcatgtgca gttcacaata
364401 gggcttacgc ttctttgaga atctaatacc gctgctgatc tgatgggagg
364451 tggagctcag gcggtaatgt gagtgatggg gagcagctgt aaatacagat
364501 gaagcttcgc tcactgccac tcacctcctg ccgtgcaacc cagttaataa
364551 caggccacgg accagtacag gcatatggcc tggggtgtgg ggaccctga
364601 tctaggagga tatagtcaat gaccatattt ttttccaaact taacatttaa
364651 attgttagga catttgttct gaaaagaatg cctgtgccat tttaagatat
364701 aagaactggg ggaagccttt tataacaagt ccaggttaag tagtatatac
364751 aaatctgaag atgtgtacag aagtgcttca gctgggtatg ccatacatgt
364801 gcaattctgg ccaaatagtc ccattcagtg aaccaattat tttccaatca
364851 caatactcac tgcaaaaaaa aaaaaatact gtattatacc taaagaacat
364901 ggcaaaaata aagtgaaagg gagtattcaa ttggtttcac tttaaggcaa
364951 gcttaactct tcctaagcac ccttgcctcc atgcccatga ctggtcacct
365001 aattgggaca actccacctg tctgacacac ctaagcatga cgttttagaa
365051 aattaacctt caatatcaat tgctgaacaa cccaaacacc ttaactgcca
365101 agaactacat taatttttcaa gcacagagca tcatgaccca cttattccct
365151 ctgcttataa ataaaacaac ttaaaagaaa tatgctagca aaaaggcaaa
365201 cataaacaag aaataaaata aaaagattaa agtcaccttg taaatggcta
365251 ctcagtttta agacatccta gcttttttcag ccaataatgg actcttaaag
```

```
365301 aagacaatat tcagaaaagg tacagattat gtaaccaaat atcaccccaa
365351 attccactac cctttataat acctctgttt tgatgcccct ctgaaataaa
365401 agaatttgaa atcagttgaa agacaaagat agaaagaaag aagatggggt
365451 taatgtgtca ccttaaaaac cacaagttgt ttgcttttt tattgagaca
365501 gggtctcgct gtgtcaccca ggctggagtg cagtggtgcg accacagttc
365551 actgcagcct tgacctccca ggctcaagca attctccacc tcagcctcct
365601 gagtagctga tactacaggc aggcaccacc actcctggtt atttttgta
365651 gagatggggt ttcgccatgt tgcccaggct ggtctaaaac tcctgagctc
365701 aagcaatcca cccaccttgg cctcccaaag tgctgagatt acaggtgtga
365751 gccaccacac ccagccggtt cttcactttt ttgaaagttc attttggac
365801 caggcgcagt ggctcacgcc tgtaatccca gcactttggg aggctgaggc
365851 gggcggatca cgaggtcagg agttcctgac cagcctgatc aacattgtga
365901 aactctgtct ctactaaaaa tataaaaaaa ttagccaggc atggtggcac
365951 gcgcctgtaa tcccagctac tcaggaggct aaggcaggag aacttgaacc
366001 tgggaggcgg aggctgcagt gagccgagat cgcgccattg caccccagcc
366051 tgggtaacag agtgagactc cgtctcaaaa aaaaaaaaaa aagaaaaga
366101 aagttcatct ttgattggta ttatatcaag ttctgtaaga atctagtat
366151 aacagaagtg cttaagaaca ggctacccaa aaacttatac aagaacagtc
366201 atgacagcac tacccacgag agtcaaaggt gggaacaacc cacatgtcca
366251 tcaacagtta agtgacaaac aaaatatggt gtatatatat ataatggaat
366301 attattcagt cataaaaggg aatgaaatac agagacatat tacgtcaatg
366351 ggcctcaaaa acattaagta aaagaagcca gacacatggg tcacatattg
366401 tatgcttccg cttatatgaa ctctccagag tcggcaaatc catagaaaca
366451 aaaagcaaac tagtggttgc taggggttgg ggggagagga gaatggagtg
366501 tgactaatta acgtataagg gctttcttct ggggtgatta aaacaattta
366551 gaatttgaca taaagggtgg atgtaggcca ggcacagtgg caggtggatc
366601 acctgaggtc aggagttcga gaacagcctg gccaacatgg tgaaacccca
366651 cctctactaa aaatacaaaa attagctggg tgtggtggct ggtgcctgta
366701 gtcttactac ttgggaggct gaggcaggaa aatctcttga actcgggagg
366751 tggaggttgc agtgagccga gattgcacca ctgcactcca gcctgggcga
366801 cagagtgaga ttctgtctca ataaaaaaaa aaaaaaaggt ggatgtacaa
366851 cattatgaat gttctaaacg caactaaact gtacccttta caatggttaa
366901 ttgcatgtta tgcgaatttg atatcaattg aaatgaaagc acttatgaga
366951 gaaaatttaa agttcatggt aatattttat aatatatgaa tacatttgat
367001 tatgcacatc tattttgacg gaacgtatga aagctaatag agaataaaac
367051 attctgagag atcccaaaac cagcaaagac acaggaaaac tggtcagttg
367101 gtagtaccat tcttcctggg tggaggtggc cctgcacttt cttacccaca
367151 gacaggaggc gccacgagac ggcgggagtg gcaaagcagg caaacacgtc
367201 gtcggtgcag gagaagtggg tgaggtgcgg gaggatcacg gactgacccc
367251 ggcactggcc ccacatgtac acgtgcccac cctgcgtctt ggctgcagac
367301 gtgtgggcag agtgacaggc tgcaatctct accaccctga aaagttttaa
367351 gaaaaatgca tgttacttca tgatcacaga agcccacagc acaccacaca
367401 aggcaattta aaagttcatg cttgcaatac ctcagaaaac agtccaagtt
367451 ccagggacac tagctgccaa gtcacagcaa caaaagcaac agatcagggc
367501 aagagcactg ttctcctttc ccaaatgccc acttctcatc ctcagctcac
367551 tgtgagttag gatagatcac acagaccgcc gaggaaaact ggaaaacag
367601 accagcaaat ccaagcaaat gaggaaagtg gacactgaga aaatgcccta
367651 acaaatgtga tggcttaaat accatttctt tttttttct ttttttgagac
367701 aggatctcac tccgtcaccc aggctagagc gcagtggcat gaccatggct
367751 cactgcagcc tcgacctccc aggctcaagc aatccttcca cctcagcttc
367801 ccagaccaca gctgcaccac catacccggc taagttttgt attttttata
367851 gagacagagt ctcgctatat tgccagggcc ggtcaccaac tcctgggctc
367901 aagtgatcct ctgccttcgc ctcccaaagt gctgggatt acaggtgtaa
367951 gccatcgtgc ctggcccatt tctttataaa tgtaacttt tctctcatct
368001 cctaccagag ctcagaacac tcattgggct gataagcatt ggctgggggt
368051 cacggactct gaacgttcca atccaaaagg aaaacaagcc aaacttacta
368101 tatttctcag tagtatgctt cttgggtaag gtctcataat cagaagtcag
368151 cactccagga cataggaggt aagaccttac aattaggctg aacaacatca
```

FIG. 5 CONT'D

```
368201 agcatctatt ccagtaacac atattatatc aaatcaatat ttaaacagat
368251 aatgtccttt caagagcaga tttatttaaa agttgttta cttggctcaa
368301 agtaaaagtt tatattacac cataaacatc aacatggcca tagaccttac
368351 ttgtcttcca tactaaaagg gcaacagcaa gactgcagta attataccaa
368401 gatgcattca cacctatcaa tcacaggtgg ttatttcaga gagctacata
368451 agaatcatat caacctcatg ttcattctgg ctactactca aaacactttt
368501 gcataggcca ggcacggtgg ggctcatgcc tataatccca gcactttggg
368551 aggccgaggt gggtagatca cttgaggcca ggagttcaag accagcctgg
368601 ccaacatggc gaaaccctgt ctctactaaa aaatacaaaa attagctggg
368651 catggtggta cacacctgta atcccagcta ctcaggaggc tgaggcagaa
368701 gaatcacttg aacccacgaa gtgaaggttg cagtgagccg agatcgtgcc
368751 attgcactcc agtctgggtg acagagactc tgtctcaaaa aagggaaggg
368801 aagggaaggg aaggggggag ggagaagggg gaagggggaa gcagggaggg
368851 agaaggagga aggggggaagg gagaagggaa ggttatctct tttgtccaaa
368901 atgagaatgt taataaacag aagaatcaca aagccaaaca ccacagctct
368951 gccacacaca gccccaaggc cacatcgcac acacagtccc aagacgtggc
369001 acagccaagt taccttttctt tctccaccat gatgtgtgct gggcttagca
369051 ggttattttt attgccagtt cccagctgcc catatgtgtt agctccccag
369101 gcatacagca agccctcatc tgttagtgct agagtatgtg cgtaaccgca
369151 gacaatctgc aagtaaattg aaacggttac cattagcagg aaaacaggaa
369201 gggcagggag aacatctact taaaggctat agccagcttc tgcagaatgc
369251 caaatcatca tcaggggtgg actgacattt gctggaacat taaaaaagca
369301 ttagaaggcc gggcgtggtg gctcatgcct gtaatcccag cgctttggga
369351 ggccgaggca ggcagatcac aaggtcagga gattgagacc atcctggcta
369401 acacggtgaa acccgtctc tactaaaaat acaaaaaatt agccaggtgt
369451 ggtggcggcc atctgtagtc ccagctactc gggaggatga ggcaggagaa
369501 tggcgtgaac tcgggaggcg gagcttgcag agagctgaga tcgtgccatt
369551 gcactccagc ctgggtgaca gagggagact ccgtctcaaa aaaaaaaaaa
369601 aaaaagcatt agaaaagcct aaaccttagg ctactgaatt tttccatttt
369651 tttttttttt tttaacttgt cgagcctgtt ttgccaacac catagtcttg
369701 cttctcctcg tgggaaatta gggaagatat aatattaaat atggaagatg
369751 aaggcacaga gtattgccag aaaagactga ctgaagagta aacctccaat
369801 atttctccaa gttagagcaa ggaaggtaga tgggaagcca ctaactgaga
369851 gtgcaccaca cgtacctggt tcacacacac gctgtgcaaa gctgccactc
369901 tcacaggggt cagctggttg ccattgtttc ccaggcccag ctgaccgttg
369951 ccattgtaac cccagccata taccttagag aggacagaag ggagagagtg
370001 agatttttaa actgctggta agaaggaaga gacaaaaaaa ccagcccatc
370051 taaacaaatc agatacttcc aacacctata ttctactcta tgctcctgca
370101 actgatctcc aaacagaagc tattttggag aaggggatga cagaattggc
370151 atcagttttct actccatgac ttactagtta gatagtctgg ggcaagtcac
370201 tcttttcctgt ttaatacatg aggaagttga gcctcactaa caattattaa
370251 gtacctactg tatgtcagaa cactctgaaa ggtactagtt tttggtcaca
370301 gtttaacagg cgaaatagat acatgcaaat tttttgctga tgggtagcaa
370351 gtgctacaat aggtataatc aaggcgctgc agaacagcaa ggaggaaggc
370401 tttagctcta ggaagaaaga ttaaggaaga ctttttcaaaa agtggagatt
370451 ggagcagagc tgaaggatga aggagagcaa aaacattcca agcagaaggt
370501 attgactgtg ttagaagcta gtttagaaga taagtaggtg ggcttggctg
370551 gacacaactg cggtagtggt agtagaaaga ctagaagaag gctgggtggg
370601 gtagctcacg cctgtaatcc cagcactttg gaaggccagc gtgggcagat
370651 caccaggtca ggagatcgag accatcctgg ccaacacagt gaaacccat
370701 ctctactaaa aatacaaaaa ttagctgggc gtggtggcgc gtgcctgtaa
370751 ccccagctac tcaggaggct gagacaggag aatcacttga acctgggagg
370801 cagaggttgc agtgagccaa gatcgtgcta ccgtactcca gcctggcaac
370851 aacaacaaca aaaagactag aaggaaaggc aagagctcag agggaaagtg
370901 acaaaaaacc taccagggaa agtgcaatac atctataaat ttctcattga
370951 aatattaatt taatttgtat ttttgaaaga taatgctggc cacagtatga
371001 aagatgatgg agcatataag gctagaggca ggaagaacct ttaggaggtc
371051 atttcttccc tcgttagcaa ataggtgagc tctgatgagg ctctaaacta
```

FIG. 5 CONT'D

```
371101 aggagtgata gggggatcat gagagggaaa gcagaggaaa gaggattaaa
371151 aatagaagac ttcccagaac gtgacagtcc cttggatata gagtgagagg
371201 aggcccatct gctgaaagta acagagctag gcataggttt gacaggagtg
371251 ttaaaggttc caaatagcca taggaaaaag tactgaccag gaacaaataa
371301 aggccttgct caaattacaa acccaagatt tgtggtggca tcgagcccca
371351 cagcaatgta gggcggcaga catagactgg ggcttttcag ggtaacatga
371401 tggagcggaa aggggaatg gactttaagg gcctggggag agatggttaa
371451 aggcactttc acccagtgcc agaagtgtaa cagacatgaa ctttctggag
371501 agaaatttgg caatggctat cagtatttca aatggcatac ttcttgaccc
371551 agaaattctt tggaaattta ttctatagaa atacttgtat aagtgtacaa
371601 agatacacat acacagagta acatagaaaa tcaccacaac tctgtctata
371651 acagcaaaaa attagaaaac tgacatgttc atcagtagag ctctgtatgt
371701 gggtcattca cagaagccaa agtcagcagc cataatgatg gaaagccgca
371751 taaatggtct gatcacagac acagataaac acaggatgct atacagggga
371801 gcgggaagca ggctgaagaa tagcagagaa aagctgcagt aggtataatc
371851 atcccatttt tttaaaaaaa gataattata ctcacccata tataattgtt
371901 taagggaaaa gtccaaaaag atatgcatga aactattaac aagattggga
371951 aaaggtattc acttttatt ttatctgttt cacttgtctt cctttacttt
372001 gttaaaataa ccatataata ataacctaaa aattaaactt attttttaaaa
372051 ataagagaag aatactggaa tggaggatat tcaacggcca tcccaaggaa
372101 ttctgaagtc atttcatgat actgagattg atttttaaa aaataagtta
372151 acataaggtc tatgcataaa ctctaaagca ccctagcaca ggggtcccca
372201 gtccccagct catgagccgc aggccggtac cagtccgtgc cctgttagga
372251 accgggccgc acagcaggag gtgagcagcg ggcaagggag tattactgcc
372301 tgagcgccac ctcctgtcag atcaatggca gcataagatt ctcacaggag
372351 cacgaacccc attgtgaact gcacaacaag gcatctaggc tgtgcgctcc
372401 atatgagaat ctaactcatg cttgatgatc tgaggtggaa cagtttcatc
372451 ccaaaaccat gccccccaaca ccgccatctg tggaaaaact gtcttccatg
372501 aaaccagtcc ctggtgccaa aaaggttggg gaccactgcc caagcacacc
372551 aatgcatgat gccaaaacat ctgtgtccag ggtaatatct ttgtataatt
372601 ttcatgcact aaaatatgca taggtagtaa atagcctatt taagtggaag
372651 ctgcatccag agactaattt cacagaaata accatcagct caaaagtgac
372701 cacagtaggg ggtaactaaa gggacagttg ttaaaagtag ctaacaacag
372751 tcaggaccccc acaaaaaatc tgcttttgca agttgcttcc tcctgtgaac
372801 attcaagata taggtaggta gttctacaag gacttcatca gttaattta
372851 aaatgtacag ttgacattgt ttcattggaa gagaaaggta ggattaaatt
372901 ctttaatcta ttacattaaa tatcacgaac aaatagctat aggcattagg
372951 ctctttggat cttgcaaaaa atacaactta gacatataga atctttactt
373001 tcaggtaaat cctggaattt agaaaagtca tactgaggag caaaaaacct
373051 ccagctcctc agtcagtaat cagttaactt tcaatggagc taccaaaaca
373101 aagcactctt ccttcttcca tctgatacat tcaccttgtg aagaaactga
373151 cgtgtaattg aaaagaagg tagaaaggga aatgggagtg gagacacctc
373201 acctcgccat tgtccagaac agccatggat gaagtctgac cacaggcaat
373251 gccaactacc ctcttaatat gtaaacagtt tgtaacttt cgaggagttg
373301 gttgatttgc tgtagaacct gatcccactt ggccacagtt gttataaccc
373351 caagcaaaca cctacaagag aaagaaaaag gaaaggaaa gaatagtcag
373401 ggtgaaaatt ctaccccaac acaaataatc ataaaatta aaattatcct
373451 acttaatgag tacttaagat gtgctaaacg gttctatatg ctttacacac
373501 attaacctat ttaacctgcc tagtaatcct gcaaagtgac cctagagtag
373551 gtagtaccca ctttatacat ctccgtttta tacatggaaa ctgaaacatg
373601 agaggttaag tgacttgctt gaggtaccaa agctggtaag tagcgctaag
373651 agaatttaac cccaagcagt ctagctatgc tcttgaccac catgctacat
373701 tccctctata atttgtgtgt gtgtgtatac acacacaact acacatacac
373751 acatacgaat gtggcatcaa taggaaatgc ggtatatgcc acataagtat
373801 tagtgatgta aaacatttgc tcaactcttt gggcataaat attcattgtt
373851 ttccatggaa accattcttt ttgttttgct ttggtttttt ttttttttt
373901 ttgagataga gtttcactct gtccccagg ctggagtgca gtggtgcgat
373951 ctcagctcac tgccagcccc gcctcccggg ttcatgtcat tctcctacct
```

```
374001 cccaagtagc tgggacgaca ggcgcccgcc accatgcccg gctaatttt
374051 tgtattttta gtagagatgg ggtttcaccg tgttagccag gatggtctcg
374101 atctcctgac cacgtggtcc acccatctcg gcctcccaaa gtgctgggat
374151 tacaggcgtg agccaccatg cccagcctca tggaaaccat tctaaacaag
374201 actataaaca gagagatgaa ttagggaggg aggtgttggc agtagaggaa
374251 ataatttcct ccaacattag gaaatgtcta agccccgct ccccaccctg
374301 cttcacgtgg ctgcaggagg tggtccacgt atatactgag tgtggcttcc
374351 atgattcttg tctgatgctg gccaaggcaa caacagtaga gccctctggt
374401 atatgtgtta caggttcatt tcacaggtac aaaacaaata acctgcaaca
374451 cctcctcaaa gtatattcac ataaatatct agtttaatta tgcaaatatt
374501 aatattcagt ataattattc aaagtaccat atgcttaaga ttaaaataaa
374551 tcaggaaccc agccggcata aattagcaag tttgagctaa tttcagcaat
374601 cattcttctg gcacttctca aatacatcac attcccttgc agtgctgctg
374651 actcttgttt aaaaactggg gctatagttc cactaaccaa gaaatggact
374701 aggaaacagt ggatctgggg catgaggcct gtgtgctatg cctggctcca
374751 gcacatccca gtcatgaaat cttggtctcc ctgagctttt gggtttgttc
374801 acttataagt tgtcctactt aataaaatct ctgtaacatc actgagggac
374851 ttcaaagaga ggaacagtat gatctaatct gtgttagaaa ccagagagga
374901 cagcaaagca agactggaca gacggatcaa cttaaaagat agggaataga
374951 agggactatg gcagtagtct aggcaggaaa tgacaagact tgaccaaagg
375001 caatggaaat ggagaggaac aaaatggagg aacaaaaagg caaaggaaat
375051 ggagaggaaa tggagatggt acaaaagatt agaagacaga atcaatagga
375101 tgagtgacct ttaagataag cacaacttgg gggcttaaca agtgttacag
375151 tacctactag gaggatagta aagttatttt ttccaaactc attacatata
375201 ctgaaaaata aaatagacct taaggatggg gtcactaaaa aaaaaagtac
375251 agaacactgt cacacatctg agctatagtc ttagcaaaga gcatgggact
375301 cagctgcctt aaaaaatgaa ctctaggttg ggtgcggtag ctcacaccta
375351 taatcccagc attttgggag gctgagacag gaggatcgct tgagcccagg
375401 agttcaagac cagcctgggc aacatagcca gattcttgtc tctacaaaaa
375451 aaaatttttt ttttaaaaga atgaattcta ctgccatcaa aagtgtaatc
375501 ttgattatac aatacacgtt atgctagaga gagagtgcac tcccacaagg
375551 tttttagcta catgcacagg gctacaatat tcacaccaca tcaagtacaa
375601 atatggtcat taaaatcaga ggattttcac aatagccaaa agtggaaaaa
375651 atccaaacat ccatgaacag atgaatagac aaacaaagtg tggcttacag
375701 caggtccttg aaaaacgtca tttcattcaa catcattttg ttataacact
375751 aatgagaaaa aatgtcaatt cccggccagg gccactgtct gtggagtctg
375801 catgtcccat gtctgtgtgg gttttctctg ggtactctga tttcctccca
375851 caccccaaag ctgtgcagac tagtttgtgt ctaagctgta tacatgtctc
375901 aatgattcta gtgagagtga gtgtgggggt atacatgagt gcaccctgta
375951 tcctgtccag ggctgcttcc cacctggtgt cctgcgctgc cagaagaggc
376001 tgtggccaca tgcaaccctg aactggaaca aacgggttgg aaaatgaatg
376051 aatgaataaa tgaatacaaa ttattagaaa ataaaaattc acaaagtagg
376101 cttgtcatgg tggctatgcc tgtattccca gcactttggg aggccgaggc
376151 gggaggatca cctgaggtca ggagttcgag accagcctgg ccaacatggt
376201 gaaacccgt ctctactaaa aatacaaaaa aattagccag gcatggtggc
376251 aggcgcctgt aatcccagct actcaggagg ctgaggcagg agaatcactt
376301 gtacccagga ggcagaggtt gcagtgggcc gagattgtac cattgcactc
376351 cagcctgggc aagaagggtg aaactctgtc tccaaaaaaa aaaaaaaaaa
376401 aaaaattcac aaagtagaca ataaccatac aaatgcataa caataaacaa
376451 cacagtcaaa cacccctcagt gagctgtcac atttgtgatc gtttgctttt
376501 gaactgtgtg gcagtaggag gtgccccttg taattttgc tttgcaaaca
376551 tttattcctt gacttaaccc accaccacta tgatcacccc aactcagtga
376601 ttcaccataa attgggtaaa taattctctt attgctttta ttaatctttg
376651 ttaaatatat gtattagttt gcatttattt aaatgtttaa gaagtggttt
376701 gggtcttcag aagtttggtg atgtctttgt gaccagaaat ataccatagg
376751 aacttaactc ttgttttttat caattagcca atggtaaaac tggtttcatt
376801 acatgtcttt ttgcttaaag ttgtagtttc caagaatcta tcaatgacat
376851 tatgtgggca cttactatat gtatccaatg gaatattatt cagccctgaa
```

FIG. 5 CONT'D

```
376901 aaggaatgaa gagaatccta tcatatggta caaagtggat gaaccttgag
376951 gatattatgc taagtgagat aaaccagtta caaaaggaca aacattgtat
377001 gattccactt acgtgaggta cctagagtaa tcaaactcaa agaaacagag
377051 tagaaagttg ttggctgggc acggtggctc acgcctgtaa tcccagcact
377101 tttggaggcc aaggcgggca gatcacgagg tcaggagatc gagaccatcc
377151 tggctaacac ggtgaaaccc tgtctctact aaaaatacaa aaaattaggc
377201 gggtgtggtg gtgggtgcct gtagtcccag ctacttggga ggctgaggca
377251 ggaaaatggc gtaaacccgg gaggcggagc ttgcagtgag cagagatcgt
377301 gccactgtac tccagcctgg gcgacagagc gagactccat ctcaaaaaaa
377351 aaaaaaaaaa gaaagttgtt gtcaggggct ggggaggac agaatgggag
377401 tgaatgttta ccagggacag cgtttcagtt ttgcaggatg aaacagttct
377451 gtgggtgcat gctggtgaca gttgtatgac aaggtgaaca tacttaacac
377501 cactgaacta tacacttaaa actggtgaag ctggtaaatt ttatgttaag
377551 tgtatttact atgatgaaaa aaaaaaagaa taaagaataa aagcagcata
377601 cttacctctc catcagctgc cagagccatt gaatgatgtg agccacaagc
377651 tacttccacc acttgcttga tcaagagatt ggtacagacc tggacgggag
377701 caatgccttg gttggtcgtc ccattcccaa gctggctata tccattgtgg
377751 ccccaggcat aaaccactcc atctgtgcac acaaagcaca caaaaaatca
377801 gctccaaaaa gaaatagtaa ccctgtactt tcttccccag aacttcgtac
377851 agctccttct ccaaccttca tttctctccc attgccccct cctctctatt
377901 aagtaaccat ggacagagta aaggagagag agatgggtga cagaacggga
377951 tagacagatg caaaatcttt aaagaaaaaa cttggtaata acatagaaag
378001 atcagttttg tgatcaaaag caaagtttac gtatgcaaga attaggcttt
378051 ctaaaagctt tgattcatct caatagtttc tgtgtcagat gccaagaaaa
378101 aggcagatga taagaaagct cgatgttaat gtttaccatt gcttaaccaa
378151 ataccaagtc acggggaacc cacagggggc gtgtggctac tcgctcacca
378201 agtataggg aaagagatag actgtttaca aaggaaacaa aagtctcagg
378251 gcttctttga agcagactat tttattttag tggcatgaaa tctggctgaa
378301 tttttttttt tttttacata aagcaaccat tttttttacgc tcatttattc
378351 tgtgtcagga atttggacag gggacaatga agatggcttg tctttgcttc
378401 acagtgtgtg tgatctcagg aagattaaaa ggctggagat gacttgagag
378451 ttgaggacta gcaacacctg gaggcattgt cactcacact gctgtgacta
378501 tctctggaaa gcataatcag cttattctaa cagattcaac tcaggaacag
378551 ccaaatgggg gagacacaca gggtaaggta tgcggggatg aggggtgcac
378601 ggagctccca tgccctccct ggcatgccac ccctcccag cacctcgatg
378651 tggtcaccaa cccggaagct cctctgtctg aattttttt ataatgactt
378701 tatcttttct gagattctga tgaagacaac ttttcttgtg ttatctcttg
378751 aagtatcatc gtttcaggca tttctttcca cagcaccccc gagtgccaag
378801 ggcaggtctc ccagagttac acattctcct cttatctttc ccatggtaat
378851 aaaacatcct gacctattaa ggacagtctg cctggcaaca acactcaagg
378901 gcaacagcag aaatccaagt attacagtta ggctgctggt cactcacagc
378951 agtccccagg caaccagggg aaacagactt ctacttgtct actgtagaac
379001 gaagacagcc cacacaaact cagagtcctc ttccaggtga catgtggctc
379051 acaagagcca ttccctccta cagaaattat gacagaaacc ataaatggga
379101 aatttcatcc tgagaaagat gaggcttaag actgaaagaa agagtataaa
379151 acacaaaaag tatgatccat gatattgtgt taaaagctac ggcaggtgaa
379201 agaaatgtcc aaactaatga gtgttttaac ccctgaaaac agaaaaatag
379251 acttaaatag agaaatgcat accttgttct tagatgggaa aattcagtat
379301 cataaagatt ctagttttc ctacataaac ttataaagtt taaatagcaa
379351 taaaagctta aagttacttt ctggaggtag acaaattgat tagaaagttt
379401 aatgggaaga ataaacaaac aagaataaat aggaaaaccc tacaaaaaaa
379451 aaagcaagaa ggtagctaat tctaccagtt actaaaacct ataacaagtt
379501 tctatgaggc tgggcttgcc tgtaatccca gcactggg aggccgaggc
379551 aagtggattg cttgaggtca ggagttcaag accagactgg ccaacacagt
379601 gaaacccac atctactaaa aaaaaaaaa aaatacaaaa atcagccagg
379651 catggtagcg cgcacctgta atcccagcta ctcaggaggc tgaggcacaa
379701 gaattgcttg aacccaggag gcggaggttg cagtgggctg agattgtgcc
379751 ttgcactcca gcctgggcaa aaaggactct atctcaaaga aaaaaaaaaa
```

```
379801 aaggttaatt ttaaaataac ctgtaattct aaataatctc aaatagaaga
379851 cgctgaatcc atgaaacaat agcaacaagt tctggaaaga aacatttaaa
379901 gatcaagaaa gaacacttgg aaataaaaca atgggaatgt taaaaatttg
379951 acataagcgt tgtaagataa agttgaagaa atttcccaga acacagatgg
380001 gagagaacat ttttaaaaaa tcatgaagat caggccaggc atggtggctc
380051 acacctgtaa tcccagcact tttggaagct gaggtgggag gattgcttga
380101 gcccaggagg ttacaggtgt gaaccacctg ctcacacagt gaggctgcag
380151 tgagccaaga ttgcaccact gcactctagc ctggacagag agaccctgtc
380201 tcaaaaaaaa aaaaaaaaaa aaatttggaa gatcactcca gaatctctaa
380251 ctttctaaga aaaattccat aaaggagaaa acaaagaaga aaattttcct
380301 tttttgaga tggggtctca ctctgaccct cactctgtca caaaggctgg
380351 agtgcagtgg cgcaatcata gctcactgca acctcaaact cctgggctca
380401 actgatcctc ctgcctcagc ctcctgagta gctgagacta caggtgcgtg
380451 ccaccatccc cggctttttt tttttttttt tttttttttt ttttaagaga
380501 catggcctcg ctatgttgac caggctggtc ttgaactccc ggcctggagc
380551 aaacgtcctg ccttggcttc ccaaagtgct gggattacag gcatgagcca
380601 ccacacacag ccaacaaggg aaactattca tgaaatatta caagaagaaa
380651 tttccagaaa tgaccaatac aataaattaa aaattacacc agagtacaga
380701 atcatgatta tgtcacaata cttaaaaaaa taaaaataaa aataaaaaaa
380751 agatccttga agcttccaaa gaggaaaaaa cagtcacata caaaatagca
380801 aaagttgcca ggcatagtgg ctcacacctg taatcccaac actttgggag
380851 gccgagccac aaggatcact tgagcccagg agtttgagac cagcctaggc
380901 aacatggtga gacctcatct ctacaaaaaa atttaaaaat gaggtgggaa
380951 gatcgcttga gcccaggagg tcaaggttgc aatgagccat aatcactcca
381001 ctgtactcct gcctgggtga cagagagaga gagaccctgc ctcaaaaaaa
381051 aaaaaaaaaa aaaaaaaagg ccaggcacag tggcttatgc ttataatccc
381101 agcactttgg gaggctgaga tgggtggatc acctgaggtc gggagttcaa
381151 gatcagcctg gtcaacatgg agaaaccctg tctctactaa aaacacaaaa
381201 attagccagg catggtagca tatgcctcta attgtacttc ggaggctgag
381251 gcatgagaat tgcttgaacc caggaggctg atgttacagt gagctgagat
381301 cgtgccactg cactccagcc taggcgatag agcgagactg tctcaaaaga
381351 aaaaaagga agaaagaac cagtgtgatg ccagaaggca tgattacgca
381401 aggcaaaagt gagataatca cctcattatg ctcaactcca gttatattca
381451 taccacatga tgatgctcag atttggattt cacagctctc ttgagaaaga
381501 tgcagagaac ttgaagtaga ttcagttagg agttacaggc acttagaagg
381551 ctagatacta aaacctgtga cagcattcta ggaagctgtg attcctcagt
381601 ctagacaaag aaaggccggg atgcaaatca tctcccaaat gccaccctag
381651 acaattatcc aacaaaaagc tgaggacctc agagaaagag agcaagagtt
381701 aatgtatcta aagtataaaa ggaagcattt aaatagataa tgaattttca
381751 gagagtgttg ggtgcccaca gtacagatcg attacacaca catacaaaat
381801 gtccactctc ccttagtgat cttgaagagg cagagtaaaa aaggacaaga
381851 acctatcaac ctgcatcccc ggttcttta atatggcaac tacatgaatg
381901 ccagagaaca gatgaagatt tcccgattca agatgcaagc aatgcacaaa
381951 gaaaggaaag ccaggtagca tctatgttta gaaaatgta ccggccgggc
382001 acagtggctc atgcctgtaa tcccagcact tgggaagcc aaggtgggcg
382051 gatcacgagg tcaggagttc cagaccaacc tggccaatat gatgaaaccc
382101 agtctctact aaaagtacaa aaattagccg gggcgtggtg gcacgcgtct
382151 gtggtctcag ctactcggga ggttgaggca gaagaatcgc ttgaacccag
382201 gagatggagg ttgagtgggc cgagatcatg ccactgcact ccagcctgga
382251 gacagagcga gactccttct caaaaaaaaa aaaaaaaaaa aaaaaatgc
382301 cgggcgcggt ggctcacgcc tgtaatccca gcactttggg aggctgaggt
382351 gggcggatca cgaggtcagg agatcgagac catcctggct aacacggtga
382401 aaccccatct ctactaaaaa tacaaaaaat tagccgggca tggtggcggg
382451 cgccagtagt cccagctact cgggaggctg aggcaggaga atggcgtgaa
382501 cccaggaggt ggagcatgca gtgagccgag attgcaccac tgcactccag
382551 cctgggcgac agagagagac tccgtctcaa aaaaaaaag aaagaaagaa
382601 aagaaaacg taccaaagga accctgaaag ttgcattgca gaacaaagac
382651 cagtgagcta ttaaggaata ggattgcagc tgtcccgctc ccgctcccat
```

FIG. 5 CONT'D

```
382701 tcccactccc gctccctctc cctctctttc cacggtctcc ctctgatgcc
382751 gagccgaagc tggactgtac tgctgccatc tcggctcact gcaacctccc
382801 tgcctgattc tcctgcctca gcctgccgag tgcctgcgat tgcagggggcg
382851 cgccgccaca cctgactggt tttcgtattt ttttggtgga gacggggttt
382901 cgctgtgttg gccgggttgg tctccagctc ctaaccgcga gtgatctgcc
382951 agcctcggcc tcccgaggtg ccgagattgc agacggagtc tcgttcactc
383001 agtgctcaat gttgcccagg ctggagtgca gtggtgtgat ctcggctagc
383051 tacgacctcc acctcccagc tgcctgcctt ggcctcccaa agtgccgaga
383101 ttgcagcctc tgcccggccg ccacccgtc tgggaagtga ggagcgtctc
383151 tgcctggccg cccatggtct gggatgtgag gagcccctct gcccggctgc
383201 ccagtctggg aagtgaggag cgcctcttcc cggccgccac cccatctagg
383251 aagtgaggag cgtctctgcc cggccgccca tcgtctggga tgtgaggagc
383301 gcctctgccc agccccgacc ccgtctggga ggtgaggagc gtctctgccc
383351 ggccgccccg tctgagaagt gaggagcccc tccacccggc agccaccccg
383401 tctgagaagt gaggagcccc tctgcccggc cgccaccccg tctgggaggt
383451 gtacccaaca gctcattgag aacaggccat gatgacgatg gcggtttcgt
383501 cgaatagaaa agggggaaat gtggggaaaa gatagagaaa tcagattgtt
383551 gctgtgtctg tgtagaaaga agtagacata ggagactcca ttttgttctg
383601 tactaagaaa aattcttctg ccttgggatg ctgttgatct atgaccttac
383651 ccccaacctg gtgctctctg aaacgtgctg tgtccactca gggttaaatg
383701 gattaagggc ggtgcaagat gtgctttgtt aaacagatgc ttgaaggcag
383751 catgctcgtt aagagtcatc accactccct aatctcaagt acccagggac
383801 acaaacactg cagtaggccg cagggtcctc tgcctaggaa aaccagagac
383851 ctttgttcac ttgtttatct gctgaccttc cctccactat tgtcctatga
383901 ccctgccaaa tcccctatg cgagaaacac ccaagaatga tcaataaaaa
383951 aataaaataa aataaataaa taaataaata aataaataaa taaaaaagtt
384001 gcattgcaac acaaatccac tgaaaaatta ggctggaagg accatcattt
384051 gctatatcta atcatccaca gctttatgga ggcagtcgaa aacctcagaa
384101 gtttgcctaa tttgcaagac atcctatagc ttttccagag ttagcccgaa
384151 gtgtttaact ttcacctgct ttatgtactt cctctcagaa attaagaagc
384201 aaacaatcca aaatcagtta tctggtatag ccctatctcc cctaagctta
384251 gaattaaccg gtcaatttct tacaaactga aagttagat gggttccctc
384301 cttaccttcg gtgctgagaa gaacatgtgg tccactcccg taactgaggc
384351 ttttaatctt ctttccacat aagccttcta gcttttggg tacaagtgta
384401 ctctggttat ctccagttcc tagacagtta ctatagttca gtccaaatac
384451 aaagacctag aaaatagata gtttttttc tgagtctttt gaccgaaagc
384501 tgtattaaaa gctcccttct ctcctctgaa aataagacat ttcaactaca
384551 gagctcagga ggtgaaaaga gactgatatg gttgttaaga aaaattcaac
384601 ctctgtggac attgcttacg tttcagaatg tttgtctata ttatgaaact
384651 cagagtgcta tggagtagac gggtattaaa tcaagaaact gaaaaaagag
384701 aaactatcaa agccatagtc ttcctgaact tcaggatctc tttatttata
384751 ccccgccttt tctccatctt tgaactggac actttgaaga ccaattgcca
384801 aataagtcct aaaacgaaac taggtttcaa gagactctta cctcatcatt
384851 gtcagtaacg tacagtgctt cactggctga ggtgccgaag acacacgcct
384901 tccgaataga cgcgatctct tgaggggaga gtagagtgaa gatgggccac
384951 tttccgacat ccaccatgac tctggcttca agcaattcct ataaataagc
385001 cgacatctct gctggaacag aaaggattcc agaaaaaaat taaatagtca
385051 ctgagctaac tttcaaaaaa aagacctgtt aataaatact aacaaaagct
385101 gattctagaa taaatgaact accttggtt acatggatca ctcactttcc
385151 cccagccatg tgtgcaatcc ctcctccacc ttcaaacccc ggactttcct
385201 acaagagaat aacgtgcaag aactagctgt ttgtcttgcc cacttcctag
385251 tcagtgctta tctgttccac atgtgcttcc aactcaccct cttcttagac
385301 ctctaaaaac agccaaagca gcaggtcaag accaagttct ggctccagca
385351 cctccaacag cacacacaga gggcgcctgc agctggagca tgcttagcca
385401 aagccttgtc cccacccacc agagatattc ttcccaccag caccaacttg
385451 gatgacaagg atcagcttca gccccaggta tcataccaca aattcaatga
385501 ggattaaacg ccgtcaaatc aggctattca ttgtcactgc atagccagac
385551 tactggaata acatttggat gtcttgacaa atgtgtgtgc aggtggaggg
```

FIG. 5 CONT'D

```
385601 ggaggtatgg gtgaggacaa gtaaaagatt tgacagggga gtaatacatg
385651 aaaatgggaa aaaaactttg gtttcaaatg gacaaaaggg gataagaaag
385701 aaagtctcct tatcatccct ccctgaccct ctcctcaaag gccaccactg
385751 ttcccagtga tctgtaattc cttctggaaa cagtgctcat ggaagcacta
385801 catgtatgca taggtgtatg tgtatcttta aaaacagaag cacaaatgga
385851 agttttttt ccctacttaa cagtacatcg gggaaatcat tctatattag
385901 cacacataga cctgctacat ttctttccaa tggtactatg gcattccatt
385951 acatcgattt agcaatttac cttattttct actgagagac atttaagtca
386001 attccagtct tttgctagaa caatagtgca attgttgcct gcacattatt
386051 gtattgacat gtcttgtttt atacagaaat ttctaaaata aattcctaaa
386101 aatgaaaatt gctaggtcaa agtctaatag ctatttact gttactagct
386151 attaatattt caaacagtct tctattgaag tagtggccat atataaaatc
386201 accatggatg taggatggca cctgtttaca cacaccttc ccacacagcg
386251 tactctcacg gcatttcagt tttgtttaaa ctggcatttc cctgtgatga
386301 gtggagttgg atgtcactta aaaaataat caggccgggg gagggggtg
386351 gctcacacct gtaatcccag cactttggga ggccaaggtg ggcagatcag
386401 gaggtcaaga gatcgagacc atcctgacca acatggtgaa accttatctc
386451 tactaaaaat acaaaaatta gctgggcatg gtggtgtgtg cctgcagtcc
386501 cagctactca ggaggctgag gcaggagaat cacttgaacc cgggaggcgg
386551 aggttgcagt gaactgagat tgtgccactg aactccagcc tggtgacaga
386601 gcgagactct gtctcgaaaa taaaaataa tgatcagaat aattgcaaca
386651 ataacaacta acttactggg cactatgtgc caagcactat ttttagaaaa
386701 tttatattta ttcattcatt taatcctcac tttaccaata aggaaatgga
386751 gaaaaagaga ttttaagaag tggcagagtc gggatctgca cccaggcaac
386801 ctgaagcctg agtctgaact cttcacctct cactcacatt ttaagagccc
386851 actgtcagcc ttttgtgcaa agtgcctatc ttttctact ggatcattgt
386901 tcttttctt gttcttgatt tataagtatt ctttgtatgg taagatgatc
386951 ttaaatgctt ttaaaagttt aaaaataaag gctgggcgca gtagctcacg
387001 cctgtaatcc tagcactatg ggagcccaag ccggaaggac tgcttgagcc
387051 cagcagtttg agaccagcct gggcaacatg gcgaaacccc atttctacaa
387101 aaaatacaaa aaaaaaaggc caggcacggt agctcactcc tgtaatccca
387151 gcactttggg agaccaaggt gggtagatca cttgaggtca agagttcgtg
387201 accagcctgg caaacatagt gaaacccccat ctttactgaa aatacaaaaa
387251 aaattagcct ggcggtagtg gcgcatgcct gtaatcccag ctacttggga
387301 ggctgaggca ggagaatcac ttgagcccgg gaggcagagg tggctgtgag
387351 ccgagactgc atcactgcac tccttgtctg ggtggcagag tgagagaccc
387401 tgtctcaaaa aaaaaaaga aagaaagaaa gaaaagaaa aattattagc
387451 caggcatggt ggcgcatgcc tgcagtctca gttactcagg aggctgaggt
387501 gagaggattg cttgaaccca ggaagtcaag gctgcagttg agccgagatc
387551 acaacgctgc actctaacct gggtgacaga gggagaccct gtctcaaaaa
387601 gattaataaa ataaacaaaa aggaacaaga tgcccctcaa acgacctctt
387651 gtgcctctta caaaacagat ggagaaagga gtcataagaa gtcaagccat
387701 ataaagccat acaagcaggt aagtaaattt caagaaaatc cagaagcagg
387751 ttttcctgga attatgaacc atatcaagtt agccttcaaa atgtttaatt
387801 ttacatgaca cagaattagc caaaaatatg actcaccacc tttaaaatta
387851 caacacaaaa ggtaagacat tcaaaaccac acaacttcct gacagcagca
387901 caattattct aaaatcatta aacaaatatg ggcaactctg ccctaagggt
387951 ttggtaatct actgcaagat caagctaacc ttcataatga tggggcatta
388001 ttatacgcac tgacttcacc cagtgctaaa tcacatgaag ctttattta
388051 caaggtattt ctccaaagac ttgtcattta agagtcaatt caagaaatag
388101 gtcatgtatc ttacatgtcc atacccatca taaagaaaa aggcatcccc
388151 aacaggcttg gtagggtggt aacaacagag tgctgaggcc tgtgtcccag
388201 gtttgctttt aaaatcagtc agtatgacag ctgtttgctg ttttgagcct
388251 gggtttcccc caaacctaga aatttgtcat tttatgttca agatataatg
388301 aagaagctgg gggatttctt gaacagataa gaacaacaga ggcagtaata
388351 ttggccaagc aagtaattat ccctagcaag acaatcaagc aaagctaaca
388401 gcaggaaaga agaaacgaat aactatcctg aacctgcctt gtcgtagaca
388451 ctgttaatta ggtagcttcc atacattatt tcatttaatc ttcgtaatac
```

FIG. 5 CONT'D

```
388501 tcttgtgagg aggagactgt aaaccatttc tgacagatga ggactgaggc
388551 tcaaaggtga aatgacgcca aggtcacaca gcagacccct ctaatttttc
388601 ttatggagaa tatcagtcct ggcccttgaa gggctgaact tcctcaacaa
388651 cttcagtgaa cttcctaaag tcacttcttt ctgactttat cttgccttgt
388701 aaatgtacag cagcatctgt ctttaaactg ttaccaatat aaaaagtatc
388751 caggccgggc ggggtagctc acacctgtaa tcccagcact ttgagaggcc
388801 gaggcgggcg gaccacctga ggtggggagt tcgagaccag cctgaccaac
388851 atggagaaac cctgtctcta ctaaaaatac aaaattaacc aagcatggtg
388901 gcacatgcct gtaatcccag ctactcaaga ggctgaggca ggagaatcgc
388951 ttgaacctgg gaggtggagg ttgcagtgaa ccgagattgc accactgcac
389001 cccagcctgg ggaagaagag cgaaacccca tctcaaaaaa aaaagaagta
389051 tccactctcc aataaaaag cattccgcaa aatgcttctg cctagatttg
389101 cctggttaaa cctcatgaat gtcatttatt cctgcacttt tgcatcaacc
389151 attgagaggc aggcctagag aacacatgtg acctctgtcc tcggagctca
389201 caacatacaa ggtgcatcct tgggctggag actgctaagg cacaaagtgt
389251 gtcttcatta gaccatgcat gctcaacctg ggcagctgag aacatgaact
389301 ggcatccttg gaattcagac aaggttccct gagaggtttt gtggggctat
389351 gtgccaggca gaacaacaga acagggtcct taacttgggc gcgtggcatt
389401 tccctcctaa ggcagcagag cgtaactgta ataccacca aaactttcta
389451 atttactcaa aattaccacc atcctcatta taatttgact attgtggtga
389501 ggtctttaat tattccattt tcctggaggc agtggcacct tttactactg
389551 ttaagaaaac cacattaagg atcataatta tatcaacctt aagaagaatt
389601 aatgtgtata cactatcaat ccaataaact aaagcaggtg caatctaaaa
389651 attaatgagt atttcatctg tgataaaatc tacgtcagac ttaagaactg
389701 tgcggttaac aatgactcaa aaatacagga tctgccaggt gcagtggctc
389751 acacttgtaa ttccagcact tgggaggta gaggcaggca gatcacttga
389801 gtccagaagt ttgagaccag cctagatgac atggtgaaac cctgcctcta
389851 caaaaaatac agaaattatc caggagtagt ggcatgcacc tggtgtccca
389901 gctacttggg aggctgaggt ggaaggatcg tttgaacctg ggaggtggag
389951 gttgcagtga gccgagatca tgccactgca ctccagccta ggcgacagag
390001 cgagactctg tctcagaaaa aaaaaaaaaa atgcaggatc cattgcaagg
390051 aacagcaaca ttatttagga cagctctgat atcatgacat ctattaaatt
390101 tgcctaaaca tgaaagaaaa gtattaacag acttattcta actatggatt
390151 tcatttcaaa ggaatataaa tgtagttcaa ctaaatttca tttaaataat
390201 cattccaggc tgggcacggt ggctgacacc tgtaatccca gcacttttgg
390251 gaggctgagg caggcagatc agttgaggtc aggagtttga gaccagactg
390301 gccaacatgg caaaaccctg tctccactaa aaatacaaaa attaccccgg
390351 gtgtggtggc gcacgctggt aatctcagct actcaggagg ctgaggtggg
390401 aggatcatct gagcccagga ggcagaggtt gcagtgagcc aagactatgc
390451 aactgtcctg agtgataaga gtgagactct gtctcaaaat aatagtaata
390501 ataataatca ctccagaggg ttgcacaata atttagatgc ttcaaatagg
390551 aagatatgaa gtgattctat ttgtgttcta ttcctgtatg aaggaggcac
390601 tgctaatgga aagaaccttc aactggccta ttcagcccag gccttccctg
390651 acagtcaagt accttggtaa gtaccctgag caaggtagcc caactctctt
390701 ccttcccatg gtgctatggt ttgtccaaat tataagcacc ccccaaggaa
390751 gcatcccaac agaagctgcc acccaaacac gtcatacagc taaactatgt
390801 gcacatccca aattcaaaac aaaaccacaa aaataaatgt accctgtaag
390851 acttagttag cttagctatg ttataaaaca atatgtcctg tatgattaca
390901 attttttctaa agtataatat atacagaaat gtatacacca aaatatatct
390951 ccatggagag attacaggtg gcatcatttt ctttctttgt attttttattc
391001 tattttttgg cctgccatcc ccacttcttt agtttgttcg tttgtttgtt
391051 ttcgtcagca gggttgtggc cagaaaacaa gtcctatcag tctcctacct
391101 cacttcccct ttagaaatta gatacaattc ctcatctttt ttttttttt
391151 tttgagatgg agtttcgctc ttgttgccca agctggagtg ctgtggcacg
391201 atcttggctc actgcaatct ccgcctcctg ggttcaagca attctcctgc
391251 ctcagcctcc caagtagctg ggattacagg cgcccaccat cacgcccggc
391301 taattttgca ttttttagt agagacgggg tttcaccatg tttgccaggc
391351 tggtctcaaa ctcccgacct caagtgatcc acctacctcg gcctcccaaa
```

FIG. 5 CONT'D

```
391401 gtgctgggat tacaggcgtg agccaccgca cctggccttc tttgtatttt
391451 taaaatatag tcccaaattt ctctcttttt ttttttttg agacagagcc
391501 tcgctctgtt gtccagtctg gagtacactg gcaccatctt ggctcactgc
391551 aaactccccc tcatcagttc aagcaattct tgtgcctcag cctcccgagt
391601 agctggaatt acaggtgtac accaccatgc ctagctaatc tttgtatttt
391651 tagtagagaa ggggtttcac catgttggcc aggctggtct caaactcctg
391701 acctcaagtg atccaccac ctgggcctcc caaagtgctg ggattacagg
391751 cgtgagccac cacacctggc cttctttgta ttttaaaat atagtcccaa
391801 atttctttt ttggggggtgg ggggtggaca gagtctcact ctgttgccca
391851 gtctggagta cactggcacc atcttggctc actgcaacct ccacctcccc
391901 agttcaagca attcttgtgc ctcagccttc tgagtggctg agattacagg
391951 tgtgcaccac cacgcctggc taattttgt attttagta gagacggggt
392001 ttcaccatgt tagccaggct ggtctcaaac tcctgacctc aggtgatctg
392051 cccacctcag cctcccaaag tgctgggatt agaggcgtga gccaccatgc
392101 tcggccagtc ccaaatttct ataacaaaca ctttgtgacc aataaaatga
392151 acaaatattt ccaatgaaaa taaaagttca attatttgaa ttatgtttta
392201 cccctaggct gttagaagtt ttaagatgta ttcttgcttt agattcataa
392251 cgtagagtgg cagaatgttt caggcaaaat ctggaaaaat gaattattaa
392301 tataaaatta aatgtagatg gtagaaatgt aagatgatac agctgctata
392351 gaaaaccaga tggtgattcc ttaaaaaaaa aaaaaaacat tagaattata
392401 ttatctagat aaactccatt tctagcatat accccaaaga actgaaagca
392451 gagacttgaa cagatagttg tataccaacg gtcaaagcag cattattcac
392501 aatagccaaa atgtgaaaat aatccaaata tccatgaaca gatgaatgga
392551 taaacaaaat gtggtctaca catacgatag aatattattc acccttagga
392601 ggaaattctg atacatacaa caacagggat gaaccctgaa gacattatgc
392651 taataagtta gacaaatatt gcatgattcc acttacatga ggtacctaga
392701 acagtcaaat tcatggagac aaagtagaat tgtgggtgcc aggagctggg
392751 gggaggtagg aatgggagt tactgtttaa tgggtacaga gtttcacttt
392801 ggggtgatga aaaagttcta ggcaacaaat atgtgaaaaa atattcaaca
392851 tcactaatca tcagagaaat ccaaatcaaa accacaatga gatactatct
392901 cacaccagtc agaatggcca ttatcaaaaa gtcaaaaaca aaagatattg
392951 gcgaggctgt acagcagagg caacactata cactgttagt gggaatgtaa
393001 attagttcag ccactgtgga aagcagtttg gagatttctc aaagaactta
393051 aaacagaact accattcaac ccaggaatcc caagactggg tatacatcca
393101 aaggaaaata aattgttcta ccaaaaaaaa aaaaaatgca cctgtatgtt
393151 catcacagca ctattcacaa tagcaaagac atggaatcaa cctaggtgcc
393201 cgttgacagt agattggaaa aagaaaatgt ggtatatata caccatggaa
393251 tactacatgg ccataaagaa gaacaaaatc atggatgcag ctacaggcca
393301 ttatcctatg tgaattaaca caggaacaga aaaccaaata ccacatgttg
393351 tcacttagaa atgggaacta aatatagggt acacgtggat ataaagacag
393401 gaacaacaga cactggagac tactacaggg gcagggaggg aggggtacac
393451 aggctaaaaa actacctatt ggatactatg ctcactacct gggtgacgga
393501 attattcgta ctccaaagct cagcatcaca cgctataccc atgtaacaaa
393551 cctgcatatg tactccctga atctaaaata aaagttgaaa ttgggtcagg
393601 tgtggtggct cacgcctgta atcccagcat tctgggaggc caagacgagc
393651 agatcacaag gtcagagatc gagaccatcc tggctaacac ggtgaaacct
393701 cgtctctact aaaaatacga aaaaattagc cgggtgtggt ggcgggcacc
393751 agtagtccca gctactcggg aggctgagga aggagaatgg catgaacctg
393801 ggaggcggag cttgcagtga gccaagattg caccactgca ctccagcctg
393851 ggcgacaggc gtcgcaaaaa aaaaaaaaa aaaaaaaaa aaaagttgag
393901 atgattttt ttaagtagtc tagagattga tggtggtgat gattgtacaa
393951 caatgtgaat gtacataatg tgactaaaat gtgtaattaa aaatcattaa
394001 aatggtaaat tttacactat atacctttta ccccaatttt ttaaaatcaa
394051 ataatcatcc tgtgggcttt tatcaagact gcattaataa actcaaagat
394101 acattctaa aattaaatat agaaaggttt cagtcctaaa aaatgtgttt
394151 ggaaaagtaa aatcatactg ttttaatcat gtcttgagaa tataagttca
394201 gattagggaa attctcaacg gagcatttat aaaagaaata tagccttctt
394251 agaatttcc agtgcataca gcaatttaaa ccagaccaaa caaattgcta
```

FIG. 5 CONT'D

```
394301 agatgacagg tccttccagg gcttgtcatc ttgataatta taaaaatgat
394351 gagctgtaat tagaatgtca gtcatcttta aatagttact tctgaagtac
394401 ctcactaaga tagtaatttt tttgcaagcc ttccatgttt tatttaggaa
394451 atactttctg aaaaacaata ttaatgtgtt gcagcctgaa ttaccactct
394501 ttatgagtta ttattaggtg aatcaatgac tttttttttt aactgtataa
394551 agataaaaca agggtgcaag gaaagaaaag aggaacgcaa aaatgcaagc
394601 agaggtagaa agagtgtaac gtccttaaag ataatatgcc aacccacttg
394651 gctcttcgta ttttctctgg cacttgaaaa tacatcctgt atccccactg
394701 cacttatcct acgtccatta gtcctacaga tcaatatccc attccctggg
394751 atggcttatc ctagctattg gcactgtccc tcagagaact tgtggcatga
394801 ggaagaaaag gttattttac tttatactct gaaagcaaat tcagtcagga
394851 caaacacagg ccttccaatt ttagaaatct acatttagaa ctggaaggct
394901 gaaggagtaa tgtagcaact aatcttttaa ttcccctaag agcacattta
394951 ttttactttc cccaaggaac aaatattaag gaaaggctaa ttttatttta
395001 gtttatttta ctgatctagc aaaaatatat ttcaacatgc ttatggagat
395051 tttaaaaaca acaggaaatg gagagaaatg gtacaggaaa actggttttg
395101 atgaaataat gttctcaata ttaaacaaca gtggaaattt agggttgatc
395151 tgtaagcaca tggcttccac acagacctca actaaccaga atgtatttgt
395201 ttgggctagt ttaaattgct gttatgtact ggcttttaaa tgccaccaat
395251 agggtattct accttagat ctggcttcta ctgaccttag agctaaggaa
395301 aagagtggga aaagagtaag caatccttca gcattggcga gcaccaagat
395351 tctgacgctt ctggtgtcat tttagaagca tgaaatgagt ttgtgtcatt
395401 ctttattatg gaagccgata gccagaggaa actggaaggg ctctgaatgt
395451 tggaacaatc attttaagta gcctaaacat tcttcagcat acaagctaca
395501 gcaagcttta aactactcaa aacagcaact tctaatatgc aaaatgatat
395551 ttttaattgc aaaaactttg aattaaagca tttacacata cactgaaaat
395601 tcctaataga ggtttctcta ttttgtaaa ctgaatgggt gatgatttta
395651 tttatcagtt taagttgcta agctgtctta cgaaaaaaat ttatttatag
395701 ttaatgagct agtgataaaa tctaaagggc cttggaaaaa agtactattg
395751 tatgctaatg tgaacaaaat ccagttgtcc ctcagtatct gtgggggacc
395801 ggttccagga tctcctgcag atactaaaat ccacagatgc tcaagtccct
395851 gatagaaaat ggcatagtat ttgcacataa cctacacaca tcctcccata
395901 tactttaaat gatctccaga ttacttataa tacctaatac aatgtaaatg
395951 cttggtaaat agttgttaac gtttattgct tggggaataa tgacaagaaa
396001 aaatactcta catgttcagt acaaatgcaa ttttaatat ttgcaatttg
396051 aggctggttg aatccacaga tgtggaatcc atggatacag agagctgact
396101 ttaatagcat acattaattc ttcttctgca atgaccccag ataccaacaa
396151 tgccagggac atcataaaga atacaatcat ggtctctgcc tctgaggaac
396201 tgaaggtcta atggaaagtc agatcctaag taagtggaaa actagaatgc
396251 aaatacaact ggaataatta aggaaatgaa tgtatcatgc aagtatatgg
396301 tccatgtgac acatgttaat atgtcaaata ggaaataatt atgtgcaaac
396351 tagtgacaac tatataaaaa ttgtatataa cagaaaacaa ttacacgaaa
396401 tcccagaaac caaattctcc atattccagc agatgataaa atgtgagcct
396451 ttcctcagtg aagatcatcc agtttcctag aagaacaaag tgttcttcat
396501 agccttcttc ctttttagc aataaatgtt ccatttgagc acaaaagatt
396551 gaagggtatg acaatcttta tttctgaatc catttaattc cagaaaaaca
396601 ttcaaataag agagctctac ggtttggggt aaactttggt atacaacatt
396651 acaacttaat gtcttccatc tatgctacag caaaagcaat tcaaaaaccc
396701 tctcaaggta caaacagcca atgttactc ttaccaattt cttacatata
396751 attctgatgg gcttttgag actgagcaaa tgctgtctca ttgagatacc
396801 aaatgtattt cccaggtcca gataagcctc taagaatcag cctcaaacat
396851 ttttaaataa aaataaaact taaaaccatt tcacccactc tatggtataa
396901 gggctgcaaa tcacaggcaa gtttcgaag atgtgctgag acactaatat
396951 gttattgccc cagctgctag aacagctgtc atccacgtct ctcttctgca
397001 aacacacagt actacaagaa tgaaagggag gccgggcgtg gtggctcaca
397051 cctgtaatcc cagcactttg ggaggccgag gcaggcggat cacgaggtca
397101 ggagatcaag accatcctgg ctaacacagc gaaacccgt ctctactaaa
397151 aatacaaaaa aattagccgg gcctggtagt gggcgcctgt agtcccagct
```

FIG. 5 CONT'D

```
397201  actctggagg ctgaggcagg agaatggcgt gagcccagga ggcacagctt
397251  gcagtgaacc gagatggtgc cactgcactc cagtttgggt gacagatcga
397301  gacttgtctc agaaaaaaaa aaaaaaagaa tgaaagggaa aggaagaatg
397351  ccctgaatgc ttgactaagg agtctgagaa tgtagccttc tcccaaagta
397401  gtttgtcatc cttcaagctg aagccacctg tacaggtgag tgaagataat
397451  accccacct  tcatttagag aacagtatga ctagtgtttt agaattctct
397501  gattgtgcct acccttttgtt tcataagttt tgttcaaatt catcactaat
397551  tttagaggaa aatgtaagtt cctacaactg tcatttccca accactaata
397601  agttatttga cttgaagcac aatttgcaat aatggcctct gtaagcattt
397651  ctttagcccc atcatccaag gggctgcttt catctcattc atttcatctc
397701  gtctcacttc taacctcagc catgtgctcg aaaagcaaac gaaccaagtg
397751  gcaatagcat tagcagtgaa aaaaataaca tatctagggt tgtgcagctg
397801  actgagatct tataaaagta ttgcttttat aggatactgt tgttttcaaa
397851  aggaaaccag aaaagaaata tcgatgatta gaaataatgt ttttctgta
397901  agtttgttct ttgttaaacc aaacaaacag gtgtcacaaa acagaacaaa
397951  aaaaccaatg atgggtcaaa gtttaaagaa atggatagat ggctgggtga
398001  agtggctcac acctgtaatc ccagcatttt aggaggcgaa ggcaggagga
398051  tcacttgaac ccaggagttc aagaccagcc tgggcaacat ggcgagactc
398101  catttcctta aaaataaaaa gattagccag tcataatggt gtgcgcctgt
398151  agttagtccc agctactcaa gaggctgagg tgggaggatc acctgagtcc
398201  aggaggttga ggctgcagtg agccgtgttc acaccactgt attccagtct
398251  gggcaagaga gcaagatcct gtctgaaaaa gaaaaaagaa atggataaaa
398301  cataatactt cattttattt tccaaatgaa ttcaaggctg gaattggtgg
398351  gtcaaattca aatctaaata tggtttcatg aatctttctc atgtggatac
398401  cccaaaagtg atttcatcta ttagtcccca gttgtatgaa aagtatcaac
398451  tgtaccctgc aatgacctaa agccaaactg aaattccagc aatggactgg
398501  cagaaccata cactattaat tcaataaatt ttcttaggta aacaggacac
398551  agagccaaca ccaacagaaa ttacatgggg ttggggatc tagacacata
398601  aacagatgct cacaacagtg tggctggtca gatgctgtgg aggcaacaga
398651  attgggaagt atgcttcagc tacctaaaga gaagcaggcg cctgcaacag
398701  tgagcactca tgccaggtaa ggctctggtg gaggaactga aagaaagtca
398751  gcatggctgc agccaaacaa ctcaggcttt atcctaagag caccaggtaa
398801  tccctgaagg gtcttaagca gggaagtggc ataaacagat gtaggtctat
398851  gaaagattac tttggctgac cacagagaca tgagacgaca aaggagtgct
398901  tagaggaagt ccagatggct atggtaagcc agaaaagaag ggattgaagc
398951  ccacactagg gaaatggaga aaattgaaca agaaggaaaa tcaagaagat
399001  tctgcaactg gctgaatggg acaaggagca ctggataagc agaaaggcag
399051  agccgaagat cacaggcaga cgctgagctt gagtgagaga gaactgtgct
399101  gccactcact acagcagaaa gcacagcagg cctcagggat gatgagtcct
399151  actatggaca tttgtgccag gtacctgtgg gatattaaag tggacaagtc
399201  ccaacagatg gatttagaaa tctgaagctc aagaaaggtc tggattggag
399251  atttggaaat ctggcatgaa atcacccagg aaaaaagcaa gtgaaataag
399301  gagagcagag taccttaaga agaactctaa gaaactccaa cgggaaaggg
399351  acagggagta ccccctagaa gggactgtga aggaagaggt agaccaggag
399401  gaaaaccagg agacagagtg tcacagagat ctggggactt gagcatcaca
399451  ggcaagaggc atgctagtgt cgaatgctgc tgagacacca aacgagggaa
399501  gggtggagaa acttccattg gatttaacaa ggagaattat cagtgacctt
399551  aacaagaaca gtttcactga ggttgtgggt ggaagaggcc aggttgcagc
399601  aggttgaggc gtatgtgaaa ggtgaagaaa aggaaaccat gagtataaac
399651  aacttgttca agaaatttca ctctgaagga aaatgagaa atcgcatagt
399701  aatcacagaa tgtgatagag ttgcaggacg ttttctgtta acctttttaa
399751  tgtaaacatt gttagaggct tgaacatgtt tgaattaatg ggaaggagcc
399801  agtagaaaca tcaaagagga gaggatgtaa caactcaatg ggccttaaga
399851  aagtagcagg gaatgggatc tgaagcagaa gtgcaacaga agcgccgggc
399901  gcagtggctc atgcctgtaa tcccagcact tgggaggcc gaggcaggtg
399951  gatcatctga tgtcaggagt tcgagaccgg cctggccaac atggtgaaac
400001  cccatctcta ttaaaaatac aaaaattagc tgggcatagt ggtgggtgcc
400051  tgtaatcgca gctactcagg accctgaggc aggagaatcg cttgaactcg
```

FIG. 5 CONT'D

```
400101 ggagacggag gttgcagtga gccaagatca caccactgca ctccagcctg
400151 ggcaacaaaa gcaaaattct gtctctaaat aaataaataa ataaataaat
400201 gcaagagaaa ctgtagaaag gagcaagtct tccttttctt ccttccacaa
400251 gaggaggagg aaagggtgaa tgtgaatgaa agccagttta aaggttagga
400301 atccagatgc tggagacata ctcattctct cattctcatt ctctctcccc
400351 gctgagtctc cattttacat gcccaccggc aatgtacaac agtgctgctt
400401 tctccagtat ttactgtctt ttgtattata cccatcctag tggatgggag
400451 gtggtatctc atggttttga ttggcatttg gagaccattc tcttctgagg
400501 tcacctattt ttccccatg aagaaagagt taggctttt gctaagagta
400551 agaggggagg tagcaataaa cagtggagtg gaggccgggt gtggttgctc
400601 acgcctgtaa tcccaacatt tgggaggcc aaggcgggag gactgcttga
400651 ggctaggtgt tcaagaccag cctgggcaac atagggagac cctgtctcta
400701 caaaaaataa aaaattagt cgaatgtggt ggtgcgcacc tgtggtccca
400751 gctacttggg agtggggagg atcacttgag cctgggagtt tgaggctgca
400801 gtgagctatg atcacatggc acactgtact ccagactggg cgacatagtg
400851 agaccctgtc tcaaaaagaa aaaagtggag tggagcaatt gggggtaaaa
400901 tggtgaagtc tgaagcagtc accagggagg atgggaaaga gcactgagca
400951 gagaaaccta gcaggatggt aagaccaagc ccagagaaag ctggagaccg
401001 taagtcttta gaggtaccca tctggtctcc tctgtgagct tttctacccc
401051 aggaaagaag tgtgcttttg tgtatgtgtg tgtgtgtgtg tgtgtgtgtg
401101 ttttaaatgt gatctaacac acagttgact tatataatta tttcattaac
401151 tgatctcctc tactaagtct attctggcta aattcagaca acactcatca
401201 taccctctt gtgcattctt cagcacgtac acaacatgta cttttttttt
401251 ttgagatgga gtctcactgt gtcgcccagg ctggagtgca gtggcacaat
401301 ctcggctcac tgcaacctct gcctcccag gtcaggtaat tctcgtacct
401351 cagcctcctg agtagctggg actacaggcg cacaccacca cgcccagcta
401401 attttttgta tttttagtag agacggggtt tcaccatgtt ggccaagctg
401451 gtcttgaact cctggcctcg tgtaatctgt cgcctcaatc tcccaaaatg
401501 ctgggattac agatgtaagc cactgcgcct ggccaatatg taacattttt
401551 aacttttgt aaaaccagag aatatttga aatgtgtccg aatgccctgc
401601 ctagattcta gactctgtga ggccccagcc tcctttccta tgcatgactt
401651 actgtttaat gtagtacaca cagaagggat atcatcatca taataaaggt
401701 cctcactttc cttcacagtt tcatctaccc cacaatgact cccaggaaaa
401751 ggagggtact gtttcagact tccagctcc cgtatattag gtggagccaa
401801 gttcttgctg cagcatacgg gcacgcttta aaattttcaa atcatttttt
401851 aaaagctaca agcttgacag ctttgggttt ttatggctac ttgttttctg
401901 aagttcacag aactttatca tttggatcac acacttaaaa aaatcacttg
401951 caaaaatctc tttaaagatg aatatgcttc ctcttcaaga gaaacagact
402001 agcgggtaga agaaaaagga cccgtctaga gtattaataa atagactgat
402051 attcacacaa tggattaaat ggattaaagt ccatcccaca gatgaactgt
402101 tatattaata gaatccaaat atacagttac atcctcgacc ctgaaagcag
402151 tttaaacggg tgaaattcac ccagtgctca cttgaaatga gtactctaaa
402201 gtttaaagca cctataaact gccctcagga ttcaatcatt tttccattcc
402251 ttccggcatt atatactttg atgttttaat gttattagcc cacaatacac
402301 accagtttca gaaactcagt ttttgtcctc taagggcttt tagtcctccc
402351 aaaaaagaa tagggcaaaa gcaaggaaga tcatgaatct ggttttctaa
402401 aagcattatt acaagactgc tttataaaat tgtaatcccc agctgcagag
402451 ttccgcagat ggcttgaaag tgtcttacat gcaaataaat aaaaacaaaa
402501 ggccacttat gcgagcagaa cacagcgtgc tcgatagtca tcttaaaccg
402551 agcaggtagg tactttatca gaggcagaca agggaaacgt cacttattta
402601 gagttcaccg cacgcctgga taaagtcct cactaacaaa atccctgcct
402651 ttgtggattc tgtgtcggaa agggaaacga taaagaatac ggtttgtgac
402701 agcactactc tcaggagacg aaggagagat gctaagatct tggaaaggag
402751 agagaatagg aagagtcgga gggagatct cctctcagta aaacggcacc
402801 cacagcagtc agcttcagc tacgagcaaa atcgagtccg tgcacctcaa
402851 aaaagagagg gaggcaggga aaactttccc tcgcctctcc ccatccttcc
402901 ctcctcctcg caggagagca cattagctga ggtgctggcg ggggccgggc
402951 cggggacccc atccctcgcc ccggacgcag cgcccgcagg gactgcccgg
```

FIG. 5 CONT'D 403001 gagcccgagc gagggaggcg ggaggtacag gagtaacggg gcactccgg
403051 cccggcctgc ggggaaggga agcaggggca gggccgaggg ggaagaggcc
403101 tccgcgagct cgaccccgcg cccacacgct acctgcgagg tcagctgctg
403151 ccgcgccgtc ccgcgggacc gcagggatct ccgaagctcc aatgggcgca
403201 gaagtgcgag cgagcggcgg tgcccaccgg cagcgaagag gaggagcgcc
403251 agggcgccgg gcccgccggg tcacgtggcc ccggccgcct cacgtgaccc
403301 ggtgcagcgc gcgcccggga cgctacccag ccgagcatcc cgcaccgccc
403351 cggccccggc cccggccgaa accctgctct tcgggcccta caacccgact
403401 tctttagaag ccgattggcc gtctcaggcc cgccccgagg ccctgccact
403451 ggagtgtccc catgaaatcc ggtggctgct gccgggactt agaggctttt
403501 gtgtctgagg aaccaggaac gcgcgaggca cgggctcctg ctctgctccc
403551 cgagatggct tggctgtggg gagggtcggc ctaccacccc agagacctag
403601 gacggaaaag cgaccgagaa acttggctcc ctgcccactc tagagcgcgt
403651 ctggccccgg ggcaccaccc aggtggtgct gcctgggagg aaaggcggcg
403701 gagctgggac tagtttgttt ttactggaga cgcgcctccc tccctccccg
403751 cccctcactt cctgattgaa agtacctgag gcaggccagg gactagggaa
403801 ggtgcagct ggacaaaggt atgaaggaag gacgagatga ggcacaggtc
403851 ctggtattgg aaagaggcag aggtacctcg gaagcatgcc atagaggtta
403901 gacgggacct aagagggcat ctggtccaac cggattcgtg ttaccagcga
403951 gtaaactgag gccaggagag ggactgctac gagctgctcc agcctatcac
404001 ctataaagac tacagtccct ttgtaaaata ccatacagct ctcggagaac
404051 tcccagttgg cgctgcagga taaaatccaa acttgttggc atagcattcc
404101 agccacttgt tcacttacct ttcccatttg agctcctagg aataaacaga
404151 aaaacatttc attttctaaa tatcaccaga taacttcact tttggtaact
404201 tgaattatta aaaagtcct accgtcctc atctcttgcc acttccccaa
404251 cattactgga ggctctggct acaaataatt tgttttcctt gactactcaa
404301 ctttctttgg attatttact ttttctctaa gtttctttac tccttttttgc
404351 tttgttcatt cttttgtctg tatctgaaat gtcctgaatc accacctccc
404401 ccacttaaag aaaaccaggg ccaatgatta aaaaaaaaaa aaaaggtatt
404451 aagaaactaa tgcaataaga gaattgagct tagttctgta tctattctga
404501 ggtctcgctc ctgttgcact agttcctgaa taaaatgttt ttaccacttc
404551 aactactgtt tggctctggt tttcttcaac agcctccaaa gtacacatca
404601 gtttcctact catctttcaa aatccaggtc aaatgccgcc tactcttgtc
404651 ttcccagcat cctcttccct gatttttag caattgaagt tcatccagac
404701 agtgtcagct gcaacttctt ccctgatttc cagaatacta tatatattct
404751 gatacacctc acactgccca gaaatagact gcgcatttcc tgtaaaaggt
404801 gaattgtcta ttgctgtctt ctcccttaga ttataaactc tttgaaacag
404851 gattcttctg ggtttagaac agcgcctggc atgtgataga cccttaatac
404901 tcactgaatg aagtggcttg cccaaagtag tggcagttga gtgaatttac
404951 tagaagaggc ctgttttgct caaagaaact aaaatcagtt tctttggtt
405001 gcaacccgat caaaagaact tgtgtaaaca tgtctgagag aaaaacgagg
405051 gcatggggtg tgagcaatca aatatgtcct gagccctcac tgcttatgtg
405101 tcagatgcca tacttggagc atcttggagg attaaaagct gaatgagaca
405151 tggttgctga taaggaatgt gtagtctggt tcattattcc agtacagggt
405201 gaaaagtatt atgatacaag gtgctaagtg aacacaaacc agggaccaca
405251 aatcagggag tcagggagaa acttcatgag aaggtcagtt ggacaggaag
405301 tagataagaa gaaagaaaaa gacattccag gagagagcaa tgtgttcaaa
405351 agtagtgaca catgaaacag tactatttgt ttaggaaaaa acaaacaggt
405401 aggtgcagtg gctcatgcct gtaatcccag gccaaggcag gcaaatcact
405451 tgaggtcaag agttcaagac cagcctggcc aactttggaa aaccctgtct
405501 ctactagaaa tacaaaaatt agccagctgt ggtggcacgt gcctgtaatc
405551 ccagctactt gagaggctga ggcacaaaaa tcacttgaac ccaggaggca
405601 gaggttgtag tgagccaaga tcgcatcact gcattccagc ctgggtgaca
405651 gagtgagact ctgtctcaaa aaaacaaaaa caagtaaccc tatattgatg
405701 ccttgatgac ttcattcaca tctaggataa aggaaaccaa attaggttaa
405751 ttttaatata cttgaaagaa tgacatattt actggtattg gtgttattta
405801 ttgtattgaa taactttcta tcaggcacat cataggctct gcatctaaaa
405851 ttggcctagg ccaggcacag tgggtcacgc ctataatccc aatgctttgg

```
405901 gaggccaagg taggtggatt gcttgagccc aggagttcaa gaccagcctg
405951 gacaacatag caagacgctg tccctataaa taaataagaa taaaactggc
406001 ttggactaac gcgaggtgat ttttaccttt tttttccagc ctcaaaagct
406051 ttctatgatt attatgtaaa ataccaaaa ttacttgttc caaagaagat
406101 gatttttttt attttttgag acagcgtctt gctctgttgc tcaagctgta
406151 ctgcagtggc atgatcataa ctcactgcag cttcaacctc catgggctca
406201 agtgatcttc ccacctcagc acctcagcct cctgagtagc taggaccaca
406251 ggtgagggcc atcaggctgg gctaatttat attttctgtg gagacggggt
406301 ttgccatgtt ggccagcctg gtctcgaact cctgagctca agcagtttgc
406351 ctacctcagt ctctcaaagt gccaagatta caggtgtgag ccaccatgcc
406401 tggccccaaa gaagattatt ttagagcact ccaaaccttt cctttagagc
406451 aaaataattc aattaacagg tagtacttta agacagaaac tgggcttaac
406501 ctccagcatg tgaaagggaa gaaccactcc acttaatgct aacacatgat
406551 tacgttggga aaagtacctg tcaagaacct aataaaatat cataaggttt
406601 gtccggacat ggtggctcac gcctgtaatc ccagcacttt gggaggccaa
406651 ggcaggtaga tcacttgagg tcaggagttt gaaaccagcc tggccaacct
406701 ggtgaaaccc tgtctctact aaaaatacaa aagttagctg ggtgtggtgg
406751 tgggcacctg taatcccagc tactcaggag gctgaggtgg gagaatcact
406801 tgaaccctgg aagcagagat tgcagtgagt cgagatcatg ccactgcact
406851 ccagcctggg caacagagta agagtccatc tcaaaaataa aataaaaata
406901 aaaaatgaat aaaattgctt ctttgtcctt tggcaggcaa aatagctttt
406951 ttatttttt attttattt tttgacacag ggtctcgccc tgtcacccag
407001 gctggagtgc agtgtcatga tctcagctca ctgcagtctc cacgtcctgg
407051 acttaagcga ccttcccacc tcagccgccc gagtagctag gactacagat
407101 gcataccacc acacctggct acttctgttt attgtttgta gacacaggat
407151 ctcactattt tgtccaggct ggtcttgaac tcctgaaccc aacggatcct
407201 cccacctcag catcccaaag tgctgggatt acaggtgtga gccactgtac
407251 ccagcccaag agagcttctt aattatggaa tttcttcact gtccatgtca
407301 gttgatggtg aaatgtttat tttttattca ttagcagtgg tccttgttcc
407351 acctgcattt agctgtggta gcaccatggc ttattaggag gtcaccaact
407401 tctggtggga gatacgcagt ctctagtctt ctgagacata gaagttctga
407451 ctgcaattga ctatgaagca ggactggtcc tctgaatgtt aacatgcatc
407501 ttgaagactt cttagagtga ccctgggatg atgatggagg tagtaagaat
407551 attctcagat ggggcttgac tcactcattt ggaatattaa aggtgaagtt
407601 acctgggaca aactcagtga ctttatgagg aaacaatcag agaaatacat
407651 aatagcggac aagaaccttt ctagccttgg tttcctcaaa aagttaaatt
407701 taggggaag gccaggcacg gtggctcaca cctgtaatca taacactttg
407751 ggaggccaag gtaggcagat cacttgaggt caggagttcg aaactaggct
407801 ggccaacatg gtgaaactcc atctctacta aaatatttt aaaacgttag
407851 cccagcgtgg tggcaggcac ctgtaatccc agctacttgg gcggctcagt
407901 caggagaatt tacttgggag gctcagtcag gagaatcact tgaacccaga
407951 ggcaaaggtt gcagtgagct gagatcacgc cattgcactc aaccctgggc
408001 aacatgagca aaactccata tcaaaaaaaa attaaaattg aaaaattagg
408051 gggttaaaaa aaagaggggg actgttctag attaaaagag actaaagaaa
408101 catgaaattc aaatgcagtg catgaacctt aggtagaatc ctggttccaa
408151 ttttatttt taagagatgg gggtctcact ctgtcaccca gcctggagtg
408201 cagtggcacc atcacagccc actgcagcct caaactcctg ggctcaaaag
408251 atcctctggc cttggcctcc taaaaggttg ggattacagg tgtgagtcac
408301 cacgccagc ccttggttc caatttttt aagctataaa taatatttg
408351 taaagaatca gaaatttaat atggactgga tattagatag tattaggaga
408401 ttactgggtt tttagatgt ggtaatagta atattaagaa catcctggct
408451 gggcatggtg gcttatgcct gtaatcccag cccttggga ggctaaggcg
408501 ggaggattgc ttgagcccag gagtctgaga ctagcctggg caacatgacg
408551 aaaccctatc tctaccaaaa attagccagg caagatggca cacagctgtg
408601 atcccagcta ctcgggaagc tgtggtggga ggattgcttg agtccaggag
408651 gtcaaggctg cagtgagcta tgattgcacc actgcactcc agtctgggca
408701 acagagcaag accttgtctc aaaaacaaa aaacaaaca aacaaaacaa
408751 aaaacaaag aaagaatgtc cctatttta tgagatgtgt accagaataa
```

FIG. 5 CONT'D

```
408801 ttaaggacag agtgtaatga ggtctgcaaa tggttcacac aaaaaattaa
408851 tactgtatat atccatgtcc ataaagaaag agaaaatatg gcaaaatgtt
408901 tgcaattgtt aaatcgagga gctattattt atacttttat ttaaactttg
408951 aaatttttctt tctttttttt tttttttttt tgatatggcg tctcgctctc
409001 ttgcccaggt tggactgcag tggcgtgatc tcagctcact gcaacctcca
409051 cctctgaggt tcaagtgact ctcatgcctc agcctcccca gtagctagga
409101 ttacaggtgt gcaccatcac gtctggctaa tttttgtatt tttagtagag
409151 atggggtttc actatgtgtg atccacccac tttgacctcc caaagtgctg
409201 ggattacaga tgagagccac cacgtccggc taaactttga aattttcata
409251 gcaaaatgtt gtaaggtggg atgagatgtg cccttatat ttcaaactaa
409301 gaaagcagga tatttcagta atttatttat tcataaagat cttttgaatg
409351 cctgccatgt gctaggcact gtaataaggt ctgggtgtac cttggtgatt
409401 aaaacagtaa tgttctcttt tataaatgtt atgctgcatt acccaatctc
409451 tcctttaaga ctgaaggatt tattccccca gcttttggga agcttgtatg
409501 ctgacagcct tcttcagtga ctgtcttgct aaagaaagct gccttattca
409551 aggtccagtc accttatagg ggcagcctgc aacaaatgac tagtcgcgcc
409601 aggcctaatc tttaatttca atgcaattac cattttttct tgttttcaaa
409651 acttaacaaa attattctaa tgtttatatg tgagaagagc caggaaatac
409701 caaaaaagaa ttctagaaaa gaagagtgat ggctatgaag agacagagta
409751 ggagcaattt actaatccat catagtgatt tcaagagttg agtattgact
409801 gctgccttct aagaacttaa aaggccctct ccgctctccc ctctcccctc
409851 tccctctcc cctctcccca cggtctccct ctcatgcgga gccggagctg
409901 gactgtactg ctgccatctc ggctcactgc aacctccctg cctgattctc
409951 ctgcctcagt ctgccgaatg cctgcgattg caggcacgcg ccgccacgcc
410001 tgactggttt tggtggagac ggggtttcgc tgtgttggcc gggccggtct
410051 ccagccccta accgcgagtg atccgccaac ctcggcctcc cgaggtgccg
410101 ggattgcaga cggagtctcg ttcactcagt gctcaatggt gcccaggctg
410151 gagtgcagtg gcgtgatctc ggctcactac aacctacacc tcccagccgc
410201 ctgccttggc ctcccaaagt gccgagattg cagcctctgc ccggccgcca
410251 ccctgtctgg gaagtgagga gtgtctctgc ctggccgccc atcgtctggg
410301 ctgtgaggag cccctctgcc tggctgccca gtctggaaag tgaggagcgt
410351 ctccgcccgg ccgccatccc atctaggaag tgaggagcgc ctcttcccag
410401 ccgccatcac atctaggaag tgaggagcgt ctctgcccgg ccgcccatcg
410451 tctgagatgt ggggagcgcc tctgccccgc cgccccatct gggatgtgag
410501 gagcgcctct gcccggccga gacccgtctc gggaggtgag gagcgtctct
410551 gcccggccgc ccgtctgag aagtgaggag accctctgcc tgcaaccac
410601 ccgtctgag aagtgaggag ccctccgcc cggcagctgc ccgtctgag
410651 aagtgaggag cctctccgcc cggcagccac cccatctggg aagtgaggag
410701 cgtctccgcc cggcagccac cccgtccgga agggaggtgg gggggtcag
410751 cccccgccc ggccagccgc ccatctggg aggaggtgg ggggtcagcc
410801 ccccgcccg gccagccgtg ccgtccggga gggaggtggg ggggtc
```

FIG. 5 CONT'D

ANGE

Exon1
ATCCGGCCGCCACCCGCAGCTGCAGCACAGTCATGGCCCAGGCGTCGCCGCCCCGG
CCCGAGAGGGTGCTCGGCGCCAGCAGCCCGGAGGCCCGGCCCGCGCAGGAGGCGCT
CCTCCTTCCCACCG Exon2
GTGTCTTTCAGGTTGCAGAAAAGATGGAAAAAAGGACATGTGCACTCTGCCCCAAA
GATGTCGAATATAATGTCCTGTACTTTGCACAATCAGAGAATATAGCTGCTCATGA
GAATTGTTTG Exon3
CTGTATTCTTCAGGACTTGTGGAATGTGAGGATCAGGATCCACTTAATCCTGATAG
AAGTTTTGATGTGGAATCAGTAAAGAAAGAAATCCAGAGAGGAAGGAAGTTG Exon4
AAATGCAAATTTTGTCATAAAAGAGGAGCCACCGTGGGATGTGATTTAAAAAACTG
TAACAAGAATTACCACTTTTTCTGTGCCAAGAAGGACGACGCAGTTCCACAGTCTG
ATGGAGTTCGAGGAATTTATAA Exon5
ACTGCTTTGCCAGCAACATGCTCAATTCCCGATCATCGCTCAAAGTG Exon6
CTAAATTTTCAGGAGTGAAAAGAAAAAGAGGAAGGAAGAAACCCCTCTCAGGCAAT
CATGTACAG Exon7
CCACCCGAAACAATGAAATGTAATACATTCATAAGACAAGTGAAAGAAGAGCATGG
CAGACACACAG Exon8
ATGCAACTGTGAAAGTTCCTTTTCTTAAGAAATGCAAGGGAAGCAGGACTTCTTAA
TTACTTACTTGAAGAAATATTAGACAAAGTTCATTCAATTCCAGAAAAACTCATGG
ATGAGACTACTTCAGAATCAG Exon9
ACTATGAAGAAATCGGGAGTGCACTTTTTGACTGTAGATTGTTCGAAGACACATTT
GTAAATTTTCAAGCAG Exon10
CAATAGAGAAAAAAATTCATGCATCTCAACAAAGGTGGCAGCAGTTGAAGGAAGAG
ATTGAGCTACTTCAGGACTTAAAACAAACCTTGTGCTCTTTTCAAGAAAATAGAGA
TCTTATGTCAAGTTCTACATCAATATCATCCCTGTCTTATTAGGGATTACCATTTC
CTAAGCCAAGAGTCATGTCAAATTGCAATCAGGCTCAAAACCAGAGACCAGGCTGT
GAAATCCACACATCTTTAGAACTAGTCGTCTCCTCTTGGCCTCAGCAGCTCTTCCC
TGTTCTTACTGGTTGACATTTTGATCACTCTTTGCACACTCTTGTGTTTTTGCTC
ACTGTCACACTCCCAGCACCTAGTATGCTCAGTAAATGTTTGTGGAATAAGTGCAT
AAAATGTTCTTAACCTTTGATTCTACTTACAGCCCATGATAGCCTCTTAGATATAA
TAAATTTGGATTATACTAAAA

FIG. 5a(i)

ANGE Protein Sequence

```
  1  MAQASPPRPE RVLGASSPEA RPAQEALLLP TGVFQVAEKM EKRTCALCPK
 51  DVEYNVLYFA QSENIAAHEN CLLYSSGLVE CEDQDPLNPD RSFDVESVKK
101  EIQRGRKLKC KFCHKRGATV GCDLKNCNKN YHFFCAKKDD AVPQSDGVRG
151  IYKLLCQQHA QFPIIAQSAK FSGVKRKRGR KKPLSGNHVQ PPETMKCNTF
201  IRQVKEEHGR HTDATVKVPF LKKCKEAGLL NYLLEEILDK VHSIPEKLMD
251  ETTSESDYEE IGSALFDCRL FEDTFVNFQA AIEKKIHASQ QRWQQLKEEI
301  ELLQDLKQTL CSFQENRDLM SSSTSISSLS Y
```

A third alternative transcript of this gene has a different initial exon and is then assumed to have the same structure of exons 2-10 as ANGE and BCAP. Exon 2 starts at base pair 247. The 5' sequence only of this transcript is shown:

FIG. 5a(ii)

NY-REN34

Exon 1

CACAAAGGCACCAAACCACAAAACGTCACACGTAAACATCATACGTGGCAACCACAAG
CCAATCAGTTGGATATTTCATTCATTGGTATACATATGGACTGTAAG

Exon 2
GTGTCTTTCAGGTTGCAGAAAAGATGGAAAAAAGGACATGTGCACTCTGCCCCAAAGAT
GTCGAATATAATGTCCTATACTTTGCACAATCAGAGAATATAGCTGCTCATGAGAATTG
TTTG Exon 3
CTGTATTCTTCAGGACTTGTGGAATGTGAGGATCAGGATCCACTTAATCCTGATAGAAG
TTTTGATGTGGAATCAGTAAAGAAAGAAATCCAGAGAGGAAGGAAGTTG Exon 4
AAATGCAAATTTTGTCATAAAAGAGGAGCCACCGTGGGATGTGATTTAAAAAACTGTAA
CAAGAATTACCACTTTTTCTGTGCCAAGAAGGACGACGCAGTTCCACAGTCTGATGGAG
TTCGAGGAATTTATAA Exon 5
ACTGCTTTGCCAGCAACATGCTCAATTCCCGATCATCGCTCAAAGTG Exon 6
CTAAATTTTCAGGAGTGAAAAGAAAAAGAGGAAGGAAGAAACCCCTCTCAGGCAATCAT
GTACAG Exon 7
CCACCCGAAACAATGAAATGTAATACATTCATAAGACAAGTGAAAGAAGAGCATGGCAG
ACACACAG Exon 8
ATGCAACTGTGAAAGTTCCTTTTCTTAAGAAATGCAAGGAAGCAGGACTTCTTAATTAC
TTACTTGAAGAAATATTAGACAAAGTTCATTCAATTCCAGAAAAACTCATGGATGAGAC
TACTTCAGAATCAG Exon 9
ACTATGAAGAAATCGGGAGTGCACTTTTTGACTGTAGATTGTTCGAAGACACATTTGTAA
ATTTTCAAGCAG Exon 10
CAATAGAGAAAAAAATTCATGCATCTCAACAAAGGTGGCAGCAGTTGAAGGAAGAGATT
GAGCTACTTCAGGACTTAAAACAAACCTTGTGCTCTTTTCAAGAAAATAGAGATCTTAT
GTCAAGTTCTACATCAATATCATCCCTGTCTTATTAGGGATTACCGTTTCCTAAGCCAA
GAGTCATGTCAAATTGCAATCAGGCTCAAAACCAGAGACCAGGCTGTGAAATCCACACA
TCTTTAGAACTAGTCGTCTCCTCTTGGCCTCAGCAGCTCTTCCCTGTTCTTACTGGTTG
ACATTTTGATCACTCTTTGCACACTCTTGTGTTTTTGCTCACTGTCACATTCCCAGCA
CCTAGTATGCTCAGTAAATGTTTGTGGAATAAGTGCATAAAATGTTCTTAACCTTTGAT
TCTACTTACAGCCCATGATAGCCTCTTAGATATAATAAATTTGGATTATACTAAAA

FIG. 5b(i)

NY-REN-34 Protein Sequence

```
  1 MEKRTCALCP KDVEYNVLYF AQSENIAAHE NCLLYSSGLV ECEDQDPLNP
 51 DRSFDVESVK KEIQRGRKLK CKFCHKRGAT VGCDLKNCNK NYHFFCAKKD
101 DAVPQSDGVR GIYKLLCQQH AQFPIIAQSA KFSGVKRKRG RKKPLSGNHV
151 QPPETMKCNT FIRQVKEEHG RHTDATVKVP FLKKCKEAGL LNYLLEEILD
201 KVHSIPEKLM DETTSESDYE EIGSALFDCR LFEDTFVNFQ AAIEKKIHAS
251 QQRWQQLKEE IELLQDLKQT LCSFQENRDL MSSSTSISSL SY
```

FIG. 5b(ii)

NM_016119.1 (NY-REN-34) Protein Sequence

```
  1 MEKRTCALCP KDVEYNVLYF AQSENIAAHE NCLLYSSGLV ECEDQDPLNP
 51 DRSFDVESVK KEIQRGRKLK CKFCHKRGAT VGCDLKNCNK NYHFFCAKKD
101 DAVPQSDGVR GIYKLLCQQH AQFPIIAQSA KFSGVKRKRG RKKPLSGNHV
151 QPPETMKCNT FIRQVKEEHG RHTDATVKVP FLKKCKGSRT S
```

FIG. 5b(iii)

FIG. 5c(i)

Homo sapiens CLLD7 protein mRNA, Exon sequences

Exon1
CTCCTCCTCTTCGCTGCCGGTGGGCACCGCCGCTCGCTCGCACTTCTGCGCCCATTGGAGCTTCGGAGATCCCTG
CGGTCCCGCGGGACGGCGCGGCAGCAGCTGACCTCGCAG Exon2
ACAGGATCTTGCTCTCTTGCCCAGACTGGAATACAGTGGTGTGAACACGGCTCACTGCAGCCTCAACCTCCTGGA
CTCAG Exon3 (start codon boxed)
AGATGTCGGCTTATTTATAGGAATTGCTTGAAGCCAGAGTC[ATG]GTGGATGTCGGAAAGTGGCCCATCTTCACTC
TACTCTCCCCTCAAGAGATCGCGTCTATTCGGAAGGTGTGTGTCTTCGGCACCTCAGCCAGTGAAGCACTGTACG
TTACTGACAATGATGAG Exon4
GTCTTTGTATTTGGACTGAACTATAGTAACTGTCTAGGAACTGGAGATAACCAGAGTACACTTGTACCCAAAAAG
CTAGAAGGCTTATGTGGAAAGAAGATTAAAAGCCTCAGTTACGGGAGTGGACCACATGTTCTTCTCAGCACCGAA
G Exon5
ATGGAGTGGTTTATGCCTGGGGCCACAATGGATATAGCCAGCTTGGGAATGGGACGACCAACCAAGGCATCGCTC
CCGTCCAGGTCTGTACCAATCTCTTGATCAAGCAAGTGGTGGAAGTAGCTTGTGGCTCACATCATTCAATGGCTC
TGGCAGCTGATGGAGAG Exon6
GTGTTTGCTTGGGGTTATAACAACTGTGGCCAAGTGGGATCAGGTTCTACAGCAAATCAACCAACTCCTCGAAAA
GTTACAAACTGTTTACATATTAAGAGGGTAGTTGGCATTGCCTGTGGTCAGACTTCATCCATGGCTGTTCTGGAC
AATGGCGAG Exon7
GTATATGGCTGGGGTTACAATGGCAACGGTCAGCTGGGCTTGGGAAACAATGGCAACCAGCTGACCCCTGTGAGA
GTGGCAGCTTTGCACAGCGTGTGTGTGAACCAG Exon8
ATTGTCTGCGGTTACGCACATACTCTAGCACTAACAGATGAGGGCTTGCTGTATGCCTGGGGAGCTAACACATAT
GGGCAGCTGGGAACTGGCAATAAAAATAACCTGCTAAGCCCAGCACACATCATGGTGGAGAAAGAAAG Exon9
GGTGGTAGAGATTGCAGCCTGTCACTCTGCCCACACGTCTGCAGCCAAGACGCAGGGTGGGCACGTGTACATGTG
GGGCCAGTGCCGGGGTCAGTCCGTGATCCTCCCGCACCTCACCCACTTCTCCTGCACCGACGACGTGTTTGCCTG
CTTTGCCACTCCGGCCGTCTCGTGGCGCCTCCTGTCTGTGG Exon10
AGCATGAAGACTTTTTAACAGTTGCAGAGTCACTGAAGAAAGAATTTGATAGTCCAGAAACTGCTGATCTGAAGT
TTCGAATTGATGGAAAATATATTCATGTCCATAAAGCTGTTTTGAAAATCAG Exon11
GTGTGAGCATTTTCGATCCATGTTCCAGTCGTATTGGAATGAAGACATGAAGGAAGTGATAGAAATCGATCAGTT
TTCTTACCCAGTGTATCGTGCCTTTCTCCAGTACCTCTACACAGACACAGTCGACCTGCCGCCAGAAGATGCTAT
AG Exon12
GTCTTCTGGATTTGGCGACATCTTACTGTGAAAACAGACTGAAAAAACTTTGTCAGCACATTATCAAGAGAGGAA
TTACTGTGGAGAATGCCTTTTCGCTATTCTCTGCTGCAGTCAGATATGATGCAGAG Exon13 (stop codon boxed)
GATTTAGAAGAATTCTGCTTTAAGTTTTGCATCAATCATTTGACAGAAGTTACACAGACTGCAGCATTTTGGCAA
ATGGATGGCCCTCTGCTAAAGGAATTCATTGCTAAAGCCAGTAAATGTGGAGCCTTTAAGAAC TGA AGCGCAAGG
CTGCTGGGTTCTGTGTGAGTGCTCTGGGGCACTGTTGAGGATGTGTCCAGTTTGTGCTCTACGGGTGATGTGATT
CTGCAGGTAAAAGACCATCAGGTTGTTTTTTCCACATCTGGGACACAGTTGTTTGTGTAGGAACATAACAAGGG
TGTACGGCTTTTCTTGAGCCCATTTTAAACAACCCTTGTTTCCAGATAAGTGTATTTTAAATGTGACCTTTCGTA
AATTTGGGCTGGAACATGTAAAAGGGTGAAAGTTAGTCGTTTTGGTCTTCTTTTCATTTTTGATTAGAGGAACT
TCTGAACTTGGAAAGGGGAAGTTGGCAGCAACTCTCCTGGGCCACGTATCAACAATCTTCTGACAGCAGGAGCAG
TGATAGTTGGGGAATTGTGAGATGAATGGAGAGGCCCCATCGTGAATTAAAGATGCTGACCTGGGGATTGTTAAG
TGCTGCCTTAGTTGCTAGTTTAGTAGCCTTACTGTGAAGGAATAATTAAGATTGTTTCAGACTTTTGTTTGTGTG
CTTGCGTTGATGACTTTTTTAACTTCAAGATAAATCAAAGTAATAAGTTTAACGTATATTAAACCTGTTGAAATG
ATAATTATGTAAAGATAAATATTCTAGGTTAGTCAAGATTTCTCTTAAGATTTAAGTGCATAAAGAATAGTAATT
TAGAAGTATCCGTGAAAAGTTGATAATGAAAGAAATTTGATGAAGGTGAATATTTTATAAATTAGAATCTCCACT
ACTTATCCAATGGTGTTTTATTTCATTAAGGTAGAACTTGAGAACTCAAGTTTAAATTGTCCCCCACCACCTTCT
TCTATAAATGCAAACTTAAGAGGAAAATAATGACATGTATAGTATACTCTTGCCTTCCTAAATTATGACTGCTGA
ATCATCATATCTACTATATATGACTGGAAGAAGTGGTTCTTCAAGTCAACCCTCTTACAAGACTTAGTGGGAATT
TGCTTTATCTACTTTAGGCCAAATCCATCACACATTGGCTTATGTGAAACTTTATCATCTTTCACTTTTGGTTTT
CCTCTGTTTTTAAACATCTTAGGTATAACAGCACAATTTCACCTTGAAAAAGCACCAAAATTATGGTGTTCCTGA
AAAGATCCTATTAAAAGACAGTAGTTTATTTGAACTGGTTATGGAAGGTGACTTTGGGATGTAAGAGTGTTCAAC
TGTGAGTTTCATCATGTGTGTCCGTTGAGCTTGCTTTTAAGAGCAATGTTTTGCTTGCTCTCTGGTCCATGAAC
TCATTTCCATTTGAGTGAGTTCCCTTAGTGAATTTTGTCTCCTGCTTGGAAAGTCTCTCTTCTGAACCTGGAGCC
TGAATACATTTTCAGAGCCAAATTACAAGTGGGTGAAGACATGCTACAACTACTATTTTTAGCAATGTTTTTAAA
TTTGTGTCTATTGGGGTGGGAAGGGGAGTGAGGCCCTAAAGATAGGAATTCACTGATAGCTGAAATAGATACAAG
CCTAGGAGCCCCAGCCCCCTTTTCTTGACCATATCACAAGTGATTGAAGCCCAGTGAATTAGTCGGTTAGAATTC
GTTCTACAACATGATAGAACTTTTCTTACTAGCTTCAGAAATGCACATTGATTTGTGCTATGATGGGTGGTGTTT
GTAACAATCACTGTTCTATAGGCTTATGATCTGAGCAAAATGTGAACTTCAGTATGTTTACTATTGCTCTTACTT
GAAAACTTTTTTTCAAAAAAAGCACAAATTAAAGTAGTAAATTCATATCCATAGATAGTTCATTCATTCAACAAA
TATTTACCAAGTTCCTAATATAAGTGAAGGACCACTTCTCATATTAGATTACTAAGTCATTTGTATGAATATGTG
TGGCAGTGAAGAGAACAGGTCTTTCAAAAAGCATTTGATTATTTTTTTAAATACACTCTCTTATTTTCTACTT
GTTTTTTTGTTAATCATAGCAGGATATGACAACTCTTATTTGAATTGATTTTTTCATCTAATGTAATAATGGAAG
CCAAAGTATTCATATTTCTTAAGATAGCCCTAAATGTACTCTTGAACTTCTTACTGGAACAATGTTTGATACTCT
AGTATGTAAGCTGTATTTATGTAATATTTAGAACGACATGTTAATAAACAAAGTAACATTAAAATA

FIG. 5c(i) CONT'D

CLLD7 Peptide Sequence

MVDVGKWPIFTLLSPQEIASIRKVCVFGTSASEALYVTDNDEVFVFGLNYSNCLGTGDNQSTLVPKKLEGLCGKK
IKSLSYGSGPHVLLSTEDGVVYAWGHNGYSQLGNGTTNQGIAPVQVCTNLLIKQVVEVACGSHHSMALAADGEVF
AWGYNNCGQVGSGSTANQPTPRKVTNCLHIKRVVGIACGQTSSMAVLDNGEVYGWGYNGNGQLGLGNNGNQLTPV
RVAALHSVCVNQIVCGYAHTLALTDEGLLYAWGANTYGQLGTGNKNNLLSPAHIMVEKERVVEIAACHSAHTSAA
KTQGGHVYMWGQCRGQSVILPHLTHFSCTDDVFACFATPAVSWRLLSVEHEDFLTVAESLKKEFDSPETADLKFR
IDGKYIHVHKAVLKIRCEHFRSMFQSYWNEDMKEVIEIDQFSYPVYRAFLQYLYTDTVDLPPEDAIGLLDLATSY
CENRLKKLCQHIIKRGITVENAFSLFSAAVRYDAEDLEEFCFKFCINHLTEVTQTAAFWQMDGPLLKEFIAKASK
CGAFKN

Homo sapiens CLLD8 protein mRNA, Exon sequences

Exon1
CCTGCGCTCGGGAGGTTTGGGCGGCTTGGCGTCGGAGGAGAGCCCCACCCGCGGAGGAACCCAGCCTTGCCAACG
GAGCTGGCGGAGCTCACTCCTCAGGTCAGGCGGGCGGCGTAGAAAACGCAGCGGAGCCAGGTGAAACCAAGGCAC
CGCCGTGGCTGGCCCCCGACAGTTCCTCTAGCCGGGAGGTTGGAGGAGCTGAAAACGCCGCGGAGCCCTCGGCCG
CCCGAGCAGGGGCTGGACCCCAGCCCTTGCAGCCTCCCTTCTCCTGGCACCCAAGTGCAGTCCTGGCTGCAGAAG
GGGCCGCGGGCGCACTGAGTTTCCAACCTCCATTTCAGCCTGTCTGTCTCAGGGTGCAGCCTTAATGAGAGGTGA
TTCCTAAGCTGCTGGGAACCTGAGGTTGTCAAAGGGGCGGCAGGAAATGGACAGCAGTATAAAACCCAGAAGCAG
AACTTGAAGGTTAAACCACTAGCCCATTTCACAG Exon2 (start codon boxed)
TGCACTATTCTTTA:TTGTTTTCCTTACAGAATGTTTCATCCATTTGTGGACCAAAAGATGGAGTTGGTTTTTAT
TTTTAAAAAGATAATGTTAATGATCTGATACCACTACAAATATTTACGTGAGAAGATTCATGGACTTGTCTTTTG
GTTGGACTGTCACTCATTTCTGAAAGTTTCTTCAGCCACAATTTCTATTTGAAAATTCAAGTATCAAAGGATACC
AGGTTTAGAATGGTATAATGATGTATTTTGTCTGAGGACTGCAAATTTTATAGAGACCACAGTTGGATTCCAGTG
ATATTCTGCAATCAAAGTGATTTGATAAACCTAATTTTGAAGCATTTTATATTTATAAGCGACATCAAAA[ATG]G
GAGAAAAAATG Exon3
GCGATGCAAAAACTTTCTGGATGGAGCTAGAAGATGATGGAAAAGTGGACTTCATTTTTGAACAAGTACAAAATG
TGCTGCAGTCACTGAAACAAAAGATCAAAGATGGGTCTGCCACCAATAAAG Exon4
AATACATCCAAGCAATGATTCTAGTGAATGAAGCAACTATAATTAACAGTTCAACATCAATAAAGG Exon5
GAGCATCACAGAAAGAAGTGAATGCCCAAAGCAGTG Exon6
ATCCTATGCCTGTGACTCAGAAGGAACAGGAAAACAAATCCAATGCATTTCCCTCTACATCATGTGAAAACTCCT
TTCCAGAAGACTGTACATTTCT Exon7
AACAACAGAAAATAAGGAAATTCTCTCTCTTGAAGATAAAGTTGTAGACTTTAGAGAAAAAGACTCATCTTCGAA
TTTATCTTACCAAAGTCATGACTGCTCTGGTGCTTGTCTGATGAAAATGCCACTGAACTTGAAGGGAGAAAACCC
TCTGCAGCTGCCAATCAAATGTCACTTCCAAAGACGACATGCAAAGACAAACTCTCATTCTTCAGCACTCCACGT
GAGTTATAAAACCCCTTGTGGAAGGAGTCTACGAAACGTGGAGGAAGTTTTTCGTTACCTGCTTGAGACAGAGTG
TAACTTTTTATTTACAGATAACTTTTCTTTCAATACCTATGTTCAGTTGGCTCGGAATTACCCAAAGCAAAAAGA
AGTTGTTTCTGATGTGGATATTAGCAATGGAGTGGAATCAGTGCCCATTTCTTTCTGTAATGAAATTGACAGTAG
AAAGCTCCCACAGTTTAAGTACAGAAAGACTGTGTGGCCTCGAGCATATAATCTAACCAACTTTTCCAGCATGTT
TACTGATTCCTGTGACTGCTCTGAGGGCTGCATAGACAT Exon8
AACAAAATGTGCATGTCTTCAACTGACAGCAAGGAATGCCAAAACTTCCCCCTTGTCAAGTGACAAAATAACCAC
TGGATATAAATATAAAAGACTACAGAGACAGATTCCTACTGG Exon9
CATTTATGAATGCAGCCTTTTGTGCAAATGTAATCGACAATTGTGTCAAAACCGAGTTGTCCAACATGGTCCTCA
AGTGAGGTTACAGGTGTTCAAAACTGAGCAGAAGGGATGGGGTGTACGCTGTCTAGATGACATTGACAGAGGGAC
ATTTGTTTGCATTTATTCAG Exon10
GAAGATTACTAAGCAGAGCTAACACTGAAAAATCTTATGGTATTGATGAAAACGGGAGAGATGAGAATACTATGA
AAAATATATTTTCAAAAAAGAGGAAATTAGAAGTTGCATGTTCAGATTGTGAAGTTGAAGTTCTCCCATTAGGAT
TGGAAACACATCCTAGAACTGCTAAAACTGAGAAATGTCCACCAAAGTTCAGTAATAATCCCAAGGAGCTTACT Exon11
GGAAACGAAATATGATAATATTTCAAGAATTCAATATCATTCAGTTATTAGAGATCCTGAATCCAAGACAGCCAT
TTTTCAACACAATGGGAAAAAAATG Exon12
GAATTTGTTTCCTCGGAGTCTGTCACTCCAGAAGATAATGATGGATTTAAACCACCCCGAGAGCATCTGAACTCT
AAAACCAAGGGAGCACAAA Exon13
AGGACTCAAGTTCAAACCATGTTGATGAGTTTGAAGATAATCTGCTGATTGAATCAGATGTGATAGATATAACTA
AATATAGAGAAGAAACTCCACCAAGGAGCAGATGTAACCAGGCGACCACATTGGATAATCAGAATATTAAAAAGG
CAATTGAGGTTCAAATTCAGAAACCCCAAGAGGGACGATCTACAGCATGTCAAAGACAGCAGGTATTTTGTGATG
AAGAGTTGCTAAGTGAAACCAAGAATACTTCATCTGATTCTCTAACAAAGTTCAATAAAGGGAATGTGTTTTTAT
TGGATGCCACAAAAGAAGGAAATGTCGGCCGCTTCCTTAAT Exon14
CATAGTTGTTGCCCAAATCTCTTGGTACAGAATGTTTTTGTAGAAACACACAACAGGAATTTTCCATTGGTGGCA
TTCTTCACCAACAG Exon15 (stop codon boxed)
GTATGTGAAAGCAAGAACAGAGCTAACATGGGATTATGGCTATGAAGCTGGGACTGTGCCTGAGAAGGAAATCTT
CTGCCAATGTGGGGTTAATAAATGTAGAAAAAAAATATTA[TAA]ATATGTAACTAACGCCTGTTTGTGAAATTAGC
TTATCAGGCTGAAATTAAAGCCATGCAAAAGAAGGTCTAGGTCCATCAAGGAAATTCCCCTCCGTTTTCCTTTGT
CATGGGGTTTATGTTTTATTTCAGATTTTATTTGTGTGACTTAGAAATTCCAGGAACACAATTAGGATATTTCA
TACACATAGGGTATCTTGTTCACTGCTGTGCTACTTTACATGAGTAGGATGGAAGTGTATATTTTATATGAAATA
CCACTGTACAATTTATAATTTATTTACAAATTATATATTAAGAGAAACAAATGTCA

FIG. 5d(i) CONT'D

CLLD8 Peptide Sequence

MGEKNGDAKTFWMELEDDGKVDFIFEQVQNVLQSLKQKIKDGSATNKEYIQAMILVNEATIINSSTSIGASQKE
VNAQSSDPMPVTQKEQENKSNAFPSTSCENSFPEDCTFLTTGNKEILSLEDKVVDFREKDSSSNLSYQSHDCSG
ACLMKMPLNLKGENPLQLPIKCHFQRRHAKTNSHSSALHVSYKTPCGRSLRNVEEVFRYLLETECNFLFTDNFS
FNTYVQLARNYPKQKEVVSDVDISNGVESVPISFCNEIDSRKLPQFKYRKTVWPRAYNLTNFSSMFTDSCDCSE
GCIDITKCACLQLTARNAKTSPLSSDKITTGYKYKRLQRQIPTGIYECSLLCKCNRQLCQNRVVQHGPQVRLQV
FKTEQKGWGVRCLDDIDRGTFVCIYSGRLLSRANTEKSYGIDENGRDENTMKNIFSKKRKLEVACSDCEVEVLP
LGLETHPRTAKTEKCPPKFSNNPKELTMETKYDNISRIQYHSVIRDPESKTAIFQHNGKKMEFVSSESVTPEDN
DGFKPPREHLNSKTKGAQKDSSSNHVDEFEDNLLIESDVIDITKYREETPPRSRCNQATTLDNQNIKKAIEVQI
QKPQEGRSTACQRQQVFCDEELLSETKNTSSDSLTKFNKGNVFLLDATKEGNVGRFLNHSCCPNLLVQNVFVET
HNRNFPLVAFFTNRYVKARTELTWDYGYEAGTVPEKEIFCQCGVNKCRKKIL

```
   1 atcctttccc cctaccaatg gggtaatcag aaagtggtca atactaaatc
  51 caaatgaagt cctttaattg caccatcaga agcagaaagg gtgatttgag
 101 aataacccag tgtattccgt ggctacataa aaaagatgat ttgagaataa
 151 cccagtgtat tccgtggata cataaaaaag atgatttgag aataatccag
 201 tgtattccgt ggatacattt gtagtgaagt tggtggctt gcttagaatc
 251 ccagctcagc gtggccaccc ggtttgtgaa gcgctgagct ccttggctca
 301 ggacacgctc cttcacctca gacccactca tgtctgtttc ttctgcgcct
 351 ttttctccgt cccatagacg gtggcatttc tcagggcttt gtcttcaacc
 401 cccttccctt gccactcaac ctgcctccct ggggccctca cccaggcatg
 451 tggtttctgc ttcttccagc gctgacagtg cccttcctgg gagtgctggc
 501 tgtgggcaga gcctgtgcgc ccgtgcgttt gtgcctcgcc tgtttggtcc
 551 tcaggcagtg tggcgggcag ggcatgaaac agcccctggt atgcaagtgg
 601 agacagaggc tgggagagag ccggtgccct gcctaaactc acgcaagcag
 651 gaagaggtaa gaccaggatt tgaacccggg agggcgagat gccatgtctg
 701 agctctttt ggagttttgt cttcctggat gttctgcaca ggcacagccc
 751 gtgtggggag aaccccgccc tagaccctc cctgacttcc ctcccaacgc
 801 ccacttccct cttggactca accaccagcg tctccacatg catccaatca
 851 ccgtgaccaa aactccattt ctccttctcc cctgcagacc gagcaccctc
 901 tgggccctgt tctgtttccc ccaaggtac tcctgtcatc tgtggatttt
 951 tctgttttt tgataaagca ttctgaaata aatcaaagcc accatagaat
1001 ttcagatacc atcatcacac ttttcaatac gaacaataat tcatctaata
1051 ctctgcttca cattcctcca attatcctag aaatactgtt tttcctgttc
1101 atttgctctg ttttctgga atggctttt gtgcccctgt gactatttga
1151 gtctgtgaca ccaggtgacc ccacctaat gtgtgctaag aatttgatgt
1201 agaaaataaa ataatattca aagcaaaggg ataaaccttt atgccagtgg
1251 ttctcaattg gggacaattt tgtctctggg gatacttggc aatgtctgga
1301 gacatcttac attgtcacgg tgcaagggag ctcctggtat ttaattgtag
1351 aggctgtgag gtgctgccaa acgtgccaca aagtacaggg caggcctcgc
1401 aaagactcat ccagcccacg atgtcaattg tgcagaggct gggaaactgg
1451 cctagaagtg tcacaggaca ctggccacaa gcccacacaa aggaggacct
1501 ctctctactt tgttgtttc tactgtttgt tgaacattta ctaaatgcca
1551 gtcagtatcc tacacactct ggatacaaca cctcatttaa tcccaaaaca
1601 actctgagag ccatgtattc cataccatta cccccatttt atagatgaga
1651 aaattggagc ccagagaggg taagcccatc gtccagggtc accaagctca
1701 ggacaagaga ttacaacact ggcctctgaa aagactcact accaccttag
1751 gagcaagtgt tagaggaagg cgaggaggag ggtgaggaag aacacgagct
1801 gactgcagga ggcgtcaggc tgagctcctg cctggagggg ggcactgcag
1851 cctgggcagc agcaggagct ggtgctgtgt gtgtatgagt gtgtgtgtga
1901 ttgtgtgtga ttttgtgatt gtgtgtgatt ttgtgattgt gtgtgtctgt
1951 gtgtatatgt gtgattgtgg gtaccgagcc gaattcgtaa tacagtgata
2001 ttttcccccc ag
```

FIG. 7 bA236m15.00303

```
   1 gaccctctgc ctggcaacca ccccgtttga gaagtgagga gcccctccgc
  51 ccgacatttg ccccgtttaa aaagtgagaa gcctctcctc tcgcccgccc
 101 cccctttggg gaagtgagga gcctttctgc ccggccaccc ccccgttcgg
 151 aaaggaagtt ggggggggtca gccccccccac ccggccagcc gccccgtccg
 201 ggagggaggt ggggggggtca gcccccccgcc tggccagccg ccccatccag
 251 gagggaggtg gggggggtcag ccctccgccc ggccagccgc cccgtctggg
 301 aggtgagggg cgcctctgcc cggccgcccc tactgggaag tgaggagccc
 351 ctctgcccgg ccagccgccc cgtccgggag ggaggtgggg gggtcggccc
 401 cccgaccggc cagccgcccc atccgggagg gaggtggggg tgtcagcccc
 451 ccgcccggcc agccgcccca tccgggaggg aggtgggggg gtcagccctc
 501 cgcccggcca gccgccccgt ctgggaggtg aggggcgcct ctgcccggcc
 551 gcccctactg ggaagtgagg agcccctctg cccggccacc ccccgtctg
 601 ggaggtgtgc ccagcagctc attgagaacg ggccaggatg acaatggcgg
 651 ctttgtggaa tggaaaggca ggagaggtgg ggagaggatt gagaaatcgg
 701 atggttgccg tgtctgtgta gatagaagta gacatgggag acttttcatt
 751 ttgttctgca ctaagaaaaa ttcctctgcc ttgggatcct gttgatctgt
 801 gaccttaccc ccaaccctgt gctctctgaa acatgtgctg tgtccactca
 851 gggttaaatg gattaagggc ggtgcaagat gtgctttgtt aaacagatgc
 901 ttgaaggcag catgctcgtt aagagtcatc accaatccct aatctcaagt
 951 aatcagggac acaaacattg cggaaggccg cagggtcctc tgcctaggaa
1001 aaccagagac ctttgttcac ttgtttatct gctgaccttc cctccactat
1051 tgtcccatga ccctgccaaa tcccctctg tgagaaacac ccaagaatta
1101 tcaataaaaa aataaattta aaaaaaaaaa aaatgactag tcaatgtcag
1151 aatgttaaga cctgatccac ggtggttcat gcctgtaatc ccagcacttt
1201 gggaggccaa agctggtgat cacttgaggc caagagttca agaccagcct
1251 ggccaacatg gtgaaagccc atctctacta aaaatatgaa aaattagctg
1301 ggtgtggtgg ctggtgcctg taatcccagc tacttgggag gctgaggcag
1351 gagaatcgct tgaacccagg aggcagaggt tgcagtgagc caagactgca
1401 ccactgcact ccagcctggg ccacagagca agattccatc tcaaaaaaaa
1451 aaaaaaaaga aagaaaaga aaaaaaatac ctgtcccttt cacctcctca
1501 ggggacatct ctgaagagtc atcccagctt tagaactccc cacaggggttg
1551 gctgagggct ggttgtgact acactgcagc ccactttctc tttctgccag
1601 ttttgcttcc atcctttttcc tccacaggtc ccaagagcat ctaccattga
1651 aaaggcatta ataaccaag tggaatgact cagccagttg atgtcagcca
1701 gcttttcat cagccaccct agtcctggca caatggattc atagaggaga
1751 catggaagca aaggaggcta tccatgggcc caactgcatg atgtcccact
1801 taccattgtt aatctagcta ctgtcacagc caaataatca ccctgacacc
1851 aacagaaact gttgctgaaa ctcagtacaa caatatccct tgaagatacc
1901 aaccagccac ttgatggcaa gttgaccca ttgaactctt tccataatga
1951 aaggagcagc cattcatttt cacaggaata ggcaggtatt ctgtgtatgg
2001 gtttgccttt cctgcctgca gtctcatcaa acatgaccat ccaagggctt
2051 agctgcattt aatccaccaa ggtggcattc cacatatcat tgcagcagac
2101 caagggacca gctttacaac aaaggacata tagcattggt cacatgacca
2151 tggaatccac tggacctatc atatggcaca ccacccaagc tactggccta
2201 ataagcaatg gaacagcctg ttgaaagctt ggctaaagtg ccagcttgga
2251 aatgataccc tgtgaggata aagcttggaa tgcttttata ctgttggtgg
2301 gagtgtaagt tagtttgacc actgtggaag acagtgtggt gattcctcaa
2351 agatctagaa ccagaaatac catttgaccc agcaatccca ttactgggta
2401 tatacccaaa agattataaa tcattctact gtaaagacac atgcacacat
2451 atgtttactg cagcactatt tacaatagca aggacttgga accaacccaa
2501 atgtccatca atgatagact ggataaagaa aatgtggcac atacacacca
2551 tggaatacta tgcagccata aaaagcatg ggatcatgtc ctttgcaggg
2601 tcatggatga aactggaagc catcattctc agcaaactag cacaggaaca
2651 gaaaaccaaa tatcacagtt ctcactcata agtgggagtc gaacaatgag
2701 aacacatgga cacagggagg ggaacatcac acaccagggc ctgtcggggg
2751 gtgggggggca agggagggga gagcattagg acaaatacct aatacatgtg
```

```
2801 gggcttaaaa cctagatgac aggttgatgg ctgcagcaaa ccaccatggc
2851 acatgtttac ctatgtcaca aacctgcaca ttctgcacat gtattccaga
2901 acttaaaatt taaaaaaaat ttttttaaa aagcactacc ctccaggatg
2951 cagtaatgcc tgaagtcagt caccattata tagtgcagta tccccaagag
3001 aatacctggg agatgaatcc atggtgtggg agcagcagtg tccccacttg
3051 ctatcagtcc cagtgaccca gttaaagaat ttatgttttc atcctcacaa
3101 atgtagccca cagggtcgaa ggtcttggtt tccaacaggg aaacatttcc
3151 accagggaac acagcaagag tcttcattga actttaagct acctcatcat
3201 gcaggcactt tgggcctttc atgccaaggg ccagcaggca aggaaaggat
3251 cccagttggg gtgattgact cttatcatca agaagcagtc cagctgttgt
3301 tacacaatgg aggcaggaag catatgtttg atacccagat cattgacttg
3351 gacatctgtt agtaccagct tggccaattt tgatggcaaa tggacaagtg
3401 cagcagctac acctgagaa ggtacggcaa atgggacaga atgcctcagt
3451 tttgagagtc tgagtcacct cactagaaaa gtcacctaaa ccttcacagg
3501 gacttgtcga gcagagggtg gggggatgaa tatcagctat agcctcaaga
3551 ccagctgcag ctgcagggag gctgtagttc atcctaccaa ccctcctttt
3601 acaagtcatc cccaggaaga gaggcccacc agtgtcccaa aggagccact
3651 cccagaattc ttgtaaagaa agtagatctg agtgacactt gctgtattag
3701 gctgttctca cattgctata aagaaatatc tgagacttgc taatttataa
3751 agaaaagagg ttttgttggt tcacggttct gcaggcttta caggaagcat
3801 agcgctgttt ttccgttatg gtggaaggtg aaggggaaac aggcaagtca
3851 catggtgaaa gcaggaggaa gtgaagggaa tggggtagat gccacacact
3901 tttaaaactg ccagatctca tgtgaactca gagcaagagc tcacttatca
3951 ccaagaggat ggcgcaagcc attcatgaag gacccaccgc accctccccc
4001 gtgatcccaa caccctctcac caggctccac cttccaacat tggggattac
4051 atttcaacct gagatttggg tggggacaaa tatccctatg ctatcacgtg
4101 ctgtggactg ccttgcctgg gttgtagctg tcatccctct ggggatggct
4151 tcagctgaag agagctgcct cagcgtaagg cctgtgccga acagctagtg
4201 tacggcgact gagtgatgcc caatcctatt ccttttgtt caatgggtgt
4251 tgattagagt gccccctcgt aaacttccta tgtgctaatc tccatctcgc
4301 agttggcttc cggggaacat cttatctgtg acagtctgtc cagtgtagat
4351 tacagtttgc agaagacagc aaacaagcaa agtagatttg tgatttgtac
4401 actgaaggaa atgaacaaga tgcaatgata gcagataaca gggaggtgta
4451 cctggaagag gtgacactta agccaagaac tataaacaga tagatgccag
4501 ccatgtgaaa agcaggtagg agagtgtgtc ccagaaagag aaacagttct
4551 gataaaagcc gatcgcaaag agtcaggcat gtttaagtac cacccagagc
4601 tttgtaatct tttaaaagt ttttctgtgg ccaggcgcgg tggctcacac
4651 ctgtaatccc agcgccttgg gaggtcaagg cgagtagatc acctgaggtc
4701 aggagtttga gaccaacatg gcaaaaccct gtctctacta aaaatttaaa
4751 aattagccgg gcatgatggc gcatgcctgt aattccagct actcagaagt
4801 ctgaggcacg agaattacct gaacctggga ggtggaggtt ggagtgagcc
4851 gagatcacgc aactgcactc cagtggtgtg atcacatctc actgccgctt
4901 tgacctcccc aggttcaggc gatctcccac ctcagcctcc caagtaactg
4951 ggactacagg catatgccac catgccccac tagttttttt tgtagagacg
5001 gtttcaccat attgtccagg ttggtctcaa acttctgggc tcaagcaatc
5051 catccaccct ggcctcccaa agtgctagga ttacagatgt gagccaccat
5101 gcatagccta aaaggtttta tttcaaatgc aatggaaagc cttcaaaagg
5151 ttttaagaca agagagtaac atgctatgat ttacatttt aaaaaattct
5201 gtctggatac tgtgtggaaa acagattgga tgggggaac cattaagaag
5251 gttatttgca gggtggggtg tggtggttca cacctgtaat cccagcactt
5301 tcggaggcca aggtgggtgg atcacgagat caggagatcg agaccatcct
5351 gaccaacatg gtgaaaccct gtctctacta aaaatacaaa aatcagccag
5401 gcgtggttgt gtgtgcctat agtcccagct attcaggagg ctgaggcagg
5451 aggctcactt gaatccagga ggtggaggtt gcagtgagcc aagattgtgc
5501 cactgcactc cagcctgggc gacagagcag gactccatct cgaaaagaa
5551 atagaaatta aaataaaata aaatgttat tgcagtatca aggaaagatg
5601 cccacccaaa gtctgtccct tcgcactaaa ccatagtcca aatgcccaag
5651 accttggaat tccatgccca gacaactcca acccacttcc aagatttgca
```

```
5701 tgggcctctt ccctaggtcc ttctcctcaa cagcagactc cacacaccta
5751 gagccatggg gtggcctgtc tgtttgtggg gaatgtggac agagtttgga
5801 agagaagtat ccacaagcat gtgggtgaag ccccttgcag tgccagatga
5851 agccaagatt ggaatggagg gagatgaggt gaggggaaag gggccagggt
5901 ggtaattgtg gggaaaagca agagagatca gattgttact gtgtctgtgt
5951 agaaagaagt agacatagga gactccattt tgttctgtac taagacaaat
6001 tcttctgcct tgagattctg ttaatctatg accttactcc caaccctgtg
6051 ctctctgaaa catgtgctgt gtcaaactca gggttaaatg gattaagggc
6101 ggtgcaagat gtgctttgtt aaacagatgc ttgaaggcag catgctcgtt
6151 aagagtcatc accactccct aatctcaagt atccagggac acaaacactg
6201 cggaaggcca cagggacctc tgcctaggaa agcaggtat tgtccaaggt
6251 ttctccccat gtgatagtct gaaatatggc ctcgtgggaa gggaaagacc
6301 tgaccgtccc ccagcccgac acccgtaaag ggtctgtgct gaggaggatt
6351 agtataagag gaaggcatgc ctcttgcagt tgagacaaga ggaaggcatc
6401 tgtctcctgc ccgtccctgg gcaatggaat gtctcggtat aaaacccgat
6451 tgtacgttct atctactgag atagggaaaa accgccttag ggctggaggt
6501 gggacatgcg ggcagcaata ctgctttgta aagcattgag atgtttatgt
6551 gtatgcatat ctaaaagtac agcacttaat cctttacctt gtctatgttg
6601 caaagacctt tgttcacgtg tttgtctgct gaccctctcc ccacaattgt
6651 cttgtgaccc tgacacgtcc ccctcttaga gaaacaccca cgaatgatca
6701 ataaatacta agggaactca gaggctggcg ggatcctcca tatgctgaac
6751 gctggtcccc cgggtcccct tatttctttc tctatacttt gtctctgtgt
6801 cttttttctt tccaagtctc tcgttccacc ttacgagaaa cacccgcagg
6851 tgtggagggg caacccaccc cttcagtaat cactccctac actgccaagt
6901 tccaatatgg aaccccctagg atttctaaat tcaaggtatg gccatccaag
6951 tcactaaaaa gctgtatctg tcaagatagg aggataggct gggtgtggta
7001 actcacacgt gtaattccga tgctctggga ggctgaggct ggaggatcat
7051 ttgagcccag gagtttaaga ccagcctgag ttacatagcg agaccccat
7101 ctctaagaga ataaaaaata taattcgcca ggtgtagtgg tgcatgcctg
7151 tggtcccagc tactcaggag gctgaggcaa gaggattgct tgagcctggg
7201 aagttgaggc tgcagtgaac tgtgattgtg ccactgcact ccaacctgat
7251 ggatgacaga atgagactgt gtcttaaaaa aaaaaaaaaa ggaggataga
7301 acatatttta tttaacaagt tattcgcttg atttctgact taaaaatttt
7351 tagacatatg gtatcccccca tttgtaattt tgcactgggt gctacggatg
7401 ttcaggatag ccccgaaagt cacgtcatct ataaagaaac aacaagagac
7451 cgaaagctgg tttcttattt caaacagtag ataatgcaca gaggataatg
7501 cagtatcttc aaaatgaaag ggaaaatttc tgtcggttta gaattccctg
7551 tctagttaaa ctggtattca aaagtgagga taaaataaag acattatcaa
7601 accaagacta agagaaattc ccactcacag acccttgctg aaagaagtcc
7651 tgaaagatgt agtttattta tttattttga gacagagtct tgctctgtca
7701 cccaggctga agtgcagtgg tgcagtcttg gcttactgca acctccgcct
7751 cctgggttca agcaattctt ctgcctcagc ctccagagta gctgcgacta
7801 tgtatgcacc accgtgcctg gctaattttt tcgtattttt agtagggacg
7851 gggtttcacc atgttggcca ggctggtctt gaactcctga cctcaagtga
7901 tctgcccgcc tcggcctccc aaagtgctag gattataggc atgagccacc
7951 acgcctggcc aggatgtagt ttagaaagag gaaaaataaa cccagcagaa
8001 aggatcagta tgtgaggctt aatgatgagc aaagaaatta ctgatttta
8051 gaggataagc acagagtgga actagactag tacctagcaa tcaagtgaaa
8101 ggtgagaggc aagattcaca gttaaaacag tctaagatct ttatgatgta
8151 aggtatacaa tttaaacttt ttcagctata acttttagt tttttttat
8201 ctcagaaaaa aatatggaat gcttcacgaa ttttttattt ttttgtgtgt
8251 ggagatgacg gggtctcact atgttcacca ggctggtctt gaactgctgg
8301 cctcaagcaa tccttctgcc ttggcctccc aaagtgctag gactacagat
8351 gtgagccacc ttactgggtc tcagctataa attttaatat ttttaaagta
8401 actatgttaa gcaaatatgc aaaaagaaag aaaaaagtg aatagttagg
8451 atgaaagacc ccttccccca gaaaagcaaa acaagtttag ttgttagtac
8501 atataaaata gtcctcattt caatatgaga aaaggcactg attttttttt
8551 tttttttttg agacggagtc ttgctctgtc gcccaggctg gagtgcagtg
```

FIG. 7 CONT'D

```
 8601 gcataatctc ggctcactgc aagctctgcc tcccgggttc acaccattct
 8651 cctgtctcag cctcccgata gctgggacta caggtgcccg ccaccatgcc
 8701 cggctaattt tttgtacttt tagtagagac gggggttcac catgttagcc
 8751 aggatggtct tgatcccctg acctcgtgaa ctgcccgcct cggactccca
 8801 aagtgctggg attacaggtg tgagccaccg cacccggcct actaatttat
 8851 tttttgtaaa actcctctaa cccaaaccac tggctataaa atactaccac
 8901 ctctgccatc attgtccccc aaatacaagt tatttttcat ctgtgaagga
 8951 agctttatga gagctattgc actttattct tataaaactc catgaaagat
 9001 agacattaaa atgtttgcag aaatctcata aacttggctt ttaaatgaat
 9051 gagtcagtca tcaacagcta tttgcacaaa actttactct tttctctgag
 9101 caatacaaag aaaacaggac agtccctccc atgaaggagc ttaaaatctg
 9151 atttggcaga cgcaagctgt ataaactcac ctggaaataa aacctgggat
 9201 agaagacagc aaatagtaaa aggctgcaat tggtataacc cttacatatc
 9251 ttggaaggct ttgactcaat acatgaaatt tgagctttaa gagaggtaga
 9301 atttcgttag agaaaactgg ggactggcat aagcataaag cactaaaaca
 9351 gagaaaggtg ttagagccaa gacagaagat attttcaaaa aagaagggta
 9401 gctgggtgtg gtggcacatt tctgtagtct tgtaactgcc cagtgggttc
 9451 gttttccttg ctgcccagat agagctgatt tatccagaca ggggagtcat
 9501 gatacagagt ttaactcaca cagagctggc tgacaggaga ccagagtttt
 9551 attattactc aaatcagtct cttcaaagat ttagagacta gggtttttca
 9601 aagacagttt ggtgggtaca gggccagtga gtcgggagtg ctgattggtt
 9651 ggatcagaga tgaaatcata gggagtcaaa gctgtcctga gctgaattgg
 9701 tttctgggtg gggcccacag gactggttga tgagtccagg tggacccatt
 9751 gttcatcaga aatgcaaaaa cccaggccgg gcgcggtcac tcacgcctgt
 9801 aatcccagca ctttgggagg ccgatgtggg tggatcacaa ggtcaggaga
 9851 tcatgaccat cctggccaac atggtgaaac cccgtttcta ctgaaaataa
 9901 aaaaaaaaaa ttagccgggc atggcgacgt gcacctgtag acccagctac
 9951 tcaggaggct gagacaggag aatggcgtga acccgggagg cggagcttgc
10001 agtgagctga gatcatgcca ctgcactcca gcctgggcga caaagcgaga
10051 ctccgtttca aaaaaaaaaa aaaaaaaaa aaaaaaaaaa ggcaaaaacc
10101 cgaaaagaca tctcaaaagg ccagtcttag gttctacaat agtgatgtta
10151 tctgcaagaa taattgagga agttgctaat cttgtggcct ccacaataat
10201 ggttggtaat attttagcta agcctgtatc ttaatagaat ccaggccct
10251 cccatcctcc taacttgacc ttccattagg tttacaaggg cagtttagtt
10301 ttggggagg gctattatcg tttaaactat aaactaaatt tgccccaaag
10351 ttaccttggc ccacatccag gaatgagtga agacagccag cctgtgagac
10401 tggaagcaag atggagtcag ccatgtcaga tttcttttac tgttgtaatt
10451 ttgcaaaggc agtttcagcc cgagctactc aggaggctga ggcttcactt
10501 gagtccagga attcgggctg tagtgcacta tcatggtggc tgtgaatagc
10551 tgctgtactc cagcctgggc aatgtagcag acccagtctt taatttaaaa
10601 aaaaaaaaaa aaaggacata tcctaatctg tcatgggagt agagttaaaa
10651 aaaaggggg ggggtaatc attatgtgaa atactgagag aaatcattta
10701 atgaatcata atatggactg aagtaaacac aaggatgaaa taattgaaaa
10751 tactgttttc aatatgacac caacttcagt attttatctc atttcccttc
10801 ttgtatatgc cattaaattt tcaaaaaatg tagcaaatat aaatacaaga
10851 tgttgacttt ctgtgagtta catatatgaa tagcttacag ttttactgct
10901 tctacataca actttatttc ctagactttc tctagcttaa aaaaatcctg
10951 cagacaagat caccattata ttgcttgtgt tttaagttca gggctgtagg
11001 cttctggttt gtaatactga gagaaacgct attaatagta ttcctaaagg
11051 cataaagctt tcctccaaac catgactctc ggaccaaggc tcctttcatt
11101 ttgtggccct gccatcttca acaagtggct tccaggtgtct ttgcagaagg
11151 ggaaagaaca aggaggacca ccgtgggaga gctgcgtgtg agcttagcct
11201 ggaaatagca cgcttctctt ccttttgtta cagtaggtag taggcagaca
11251 tgagcagggc aggaaagcac cccctacca caaccaggaa tgtcaggaaa
11301 ccatcaggta atggtcaggc ggttgttaac tgtctctcta aaataataat
11351 tggttgcagc cagcgccaga gaaaggcagg ctctcaataa atagaaaaca
11401 cccgaaactg gtgatcagca gcttcctggt aagatctcag gagttgggtg
11451 agtgggctca agcatgaaaa ctaaggcaaa atggcagagt ttaaccagta
```

```
11501 tatgaccttc ctctagaaca ctcaactggt aagggaaaaa cgcctcaagt
11551 gagcatgtgc acagcttcag taaacacact gcacatgcgg ctcctcccaa
11601 gtgctggcag gccagtgcga atgcagacag cccaccccaa aggaagaact
11651 gggagaagag atgttaccca ctggaagcat gccagtgtat aaagcccga
11701 gtcaaaggtc aaactgtaca cttgaatctt tcacgttacc tgcttggccc
11751 tcttccaagt gtactttttt aaaattcctg ctctaaaact ttttaaagac
11801 tttcactcct gctctaaaac ttgcctcagt ctctccctct gccttatgcc
11851 cctcagtcaa gttctttctt ctgaggtggc aagaattgag gctgctgcag
11901 acctgtacag attcactgct gctaacactt tcacattcca ctgatcagga
11951 ctcagttgca tggccacagc taacttaagt gaagatggaa aatgtggttt
12001 aactgtttgc tcaggaagaa aaagaaacag tttagtaaac agttggccag
12051 tctctgccat acatacgttt ttcccattta atcctaacaa ccctataaga
12101 tatgtgcagt aacttatccc actttatgga tgaggaaatt gaaatctttt
12151 ttacgtgtac aaatttatgg ggtacatgtg aaatttagtt acatgtatat
12201 aatgtggact aatcaagtct cgttttttt gttttgcatt ttttttttgtt
12251 tgtttttct tttttttgag acagggtctt gctcatggct cattgcagcc
12301 ttgacctccc aggcttcagc aatcctccta tctcagcttc cctggtagct
12351 aggactataa gtgcatgcca ctgtgcctgg ctaattttt tatttttgt
12401 aaagacggag tttcaccatg ttgcataggc tggtctctaa ctcctaaact
12451 caaaccatct gcccacctgg gtctcccaaa gtgctgagat tacaggtgtg
12501 agccaccatg cctggaaaga aactgaaatt ttgataggct gagtaccata
12551 cctaatacct cacagttaat aaatggcaga actcaaactc aaacctaggc
12601 agtccaactc cagaaaccat attcttaaa aagctactgt aacatgactg
12651 atattccttt tactgaagaa gaatatttaa gccttttta attgtaagag
12701 gggtatgata attatggaac tttaagtaaa tacaaaccca tcattttgga
12751 gaagatgata ctgagattta gaggcggaat gttctactga aggttaaatc
12801 attgctgcct atgtaccata cgatgtaaag taacattttt ttaaagagaa
12851 tgcaatcttg gccgagcgca gtgggcctgt aatcccagca ctttgagagg
12901 ccgaggtggg cggaccactt gaggtcagga gttcaagacc agcctggcca
12951 atatggtgaa accccgtctc tactaaaaat acaaaaatta ggccaggcac
13001 ggtggctcac acctgtaatc ccagcacttt ggaaggtcaa ggcgggtgga
13051 tcacctgagg tcaggagttc aagaccagcc tggccaacat ggagaaaccc
13101 cgtctctact aaaaatacaa aaaaaatt agccaggtgt ggtggcacat
13151 gcctgtaatc ccggctactt gggaggctga ggcaggagaa tcacttgaac
13201 ctgggaggcg gaggttgcag tgagccaaga tcatgccatt gcactccagc
13251 ctgggcaaca agagtgaaac tccgtctcaa aaaaaaat tagccaggca
13301 tggtggtggg cgcctgtaat cccagctatt cgggaggctg agacaggaaa
13351 atcacttgaa accaggaggt agaggcttca gtgagccaag atcacaccac
13401 tgcactccag cctgggggac agagcaagac tctgtctcaa aaataaaat
13451 aaaaataaaa aaagaaaat acaatcttca caacttaata acttatgtta
13501 ttctttctaa aaattaattt cctaaaccat gtagtttaat gtgatttaat
13551 gtagttaaat actagcatta aaacttgttt cttgaagggc gcagtggctc
13601 acacctgtaa tcccagcatt tgggaggct gaggagggca gatcgcctga
13651 agtcaggagt tcgagaccag cctggctaac atggcgaaaa cccatcttta
13701 gttaaaatac aaaaattagc tgggttggt ggtgcatgcc tgtaatccca
13751 gctgctcggg aggctgaggc acaagaattg cttgagcccg ggagatggag
13801 gttgtagtga gccgatatcg caccactgca ctccagcctg gctacagag
13851 actctgtcaa aaaaaaaga aagaaaga aagcagaaa cttgtttctt
13901 gatgaagttt gttttcctgg gatcacacac agatctccca cggtggtcct
13951 tcttgttctt tctccttctg caaagaccct ggaaccgct tgttgaagat
14001 ggcgggggcca cagaatgaaa ggagccttgg tccctgagtc acggcttgga
14051 ggaaagcttt atggcgttta ggaacactat tgtttgttgg tcctgaagag
14101 gaagtacttc acagagcaag cctgccacca tgtggcgcgg gcccaaacct
14151 agcatcagtt aaaggttcat tctcatttac ttggttgcct ctggttcact
14201 tactaaccaa tctagattta atgctgtcta ataagaaatt aatacccagg
14251 tgtattctat aggtttaagt agtttttaat ttcaagatac atttcttcaa
14301 ttctgaaatt attgcaatat ttccaaactg gctacaggag tgaccacaac
14351 atttataata tgatccaggc acattcacaa gaggactact tcagtgcatc
```

FIG. 7 CONT'D

```
14401 acaaacatgg aaacaaactc agcaatttgt aggatttatc tcagttcact
14451 caaaagttgg tcaatgagcc agattagaag gcagaattcc ggccaggtgt
14501 ggtgggtcat gcctgtaatc acagtgcttt gggaagctga ggtgggagga
14551 ttgcttgagc ccaggaattt gagaccagcc tgggcaacag ggtgagacct
14601 tgtcgctata aaaataaaa aataagagg cagaattcct tggaatggaa
14651 acaggtagtg tgaaggactg ccaaaaatgg atgaaaaacc ctcatggaag
14701 gagagtcaga acttaacagt ttcctagagt tttaacaccg tataagctca
14751 ctatgttcta gcatgccagg ctgacgtttc ccagaactct ctctacattt
14801 atcaagacag gaatgacatc ggaagttgtt tgcaagacta taggtctagc
14851 aggtggctaa gaggaagtct ggtattgctg ctgcgtctat ttttatgtat
14901 ttattcattt atttttaag acgaagtctc actctgttgc ccagccagga
14951 gtgcagtggt gcaatctcag ctcactgcaa cctccacctc ctgggttcaa
15001 gcaattctcc cacctcagcc tcctgaccac ctcccaggtt caagcaattc
15051 tcctgcctca ccctcccgag tagctgagat tacaggtgcg tgccaccaca
15101 cctggctaat tttgtatttt taatagaggg gttttaccat gttggccagg
15151 ttggtgtcga actcttggcc tcaagagatc tgcccacctc agcctcccaa
15201 agagctggga ttacaggcat aagccactgt gcctggcctt ggtatagctg
15251 ctgcttctaa cacttgcttc taatgattgg tgggtggagg cagcagtact
15301 cacattctga tacagttatt aaatgttcct ttttttcttt ggtcctatta
15351 ctacttcttt cttttctac cactgcaaac tctgaaatat ctattacaca
15401 taaaatgtca actataactc acctgatttc actgtagaaa gcaattaaaa
15451 gggaaaaatt gtatttactt gagggtgaaa aaaaaaccc acatcatcct
15501 tttctttatg ttcctttttt acactgatat ataaacttgt tatttccacc
15551 taactaaatt gattcattta atccagtgac tgtggttaaa ttgaaaaaag
15601 gtttgaaaag aggggggtgtc tatggaaacc caaacttctt cacactccag
15651 cttttcact accttctcac ctccccagct tccacatttt cgcaagcatg
15701 ggtatatatg tcccaaggct gtggttccca ggggccaaaa gtatatgaat
15751 aagcctatat tatgtaaacc tttcatcttt taggacatgc tgtgccttcc
15801 atttagagca tttatcatct ccattctgat caccatgtaa ccagatatga
15851 tgggcccagt gatagcttcc ctagaagcct catcactcct tgttctagaa
15901 aggtcaggtg cagatggcct gactcagccc agctctagag actgggacac
15951 atctctggtt cttgttcatt cttctctttg gcctatgtgt tacaaatcag
16001 ccttccttat cattgaagta gtatgtatgg gcttaggaaa gagatcactt
16051 ccttttctct aaagagctca ccatatggtc taatctaaac tagctcagca
16101 ggattctata gtgggatctg aggttttagt gaaattaaat gtgctattta
16151 gatgaatatt gtctagattc cctatttaaa ggaaaaatgg ttcctttcca
16201 tataaaataa atgtattgtt tctgtaagaa atttcttaca ttctttttctc
16251 taatcatctc tttgcaatat gtgatggata ttgctttttt ttttttaaga
16301 ggcaaggtct tgctcgcatg atcatagctc atggtggcct ctacctcctg
16351 ggttcaagtg atcctcccac ctcagcctag ctgagactac agcctacctg
16401 ggactacagg tgtgtgccac catgcctgac taaaaaaaaa attgttttg
16451 tagagacagg atctcactat gttgcccagg ctggtctcaa actcctggct
16501 tcaagcaatt ctcctgtctt ggcttccag agtgctggga ttacaggtgt
16551 gagtcactgt gcctggccaa gttattgcta aatattaact gaattacaat
16601 tgataaaaaa taatatccca cttatgttct aaaatattcc agactaaaat
16651 ataacatcct taaatattat ttgctattgt atactaacct ttacctatgt
16701 agccagattt cacaaatctt acaatataaa ttttcccaa gtcttctcca
16751 tgaattatat tcctttgtat atgaggaaaa acaaatggca actgctgttt
16801 ctttgtatgt gctcataatt gaatttaagg ggtcctcaaa cttataaagg
16851 atatctgtca agaacctaga gaaaatatta catttaatgg taaaacatta
16901 gaaacatcac cactgaagtg atgtatggat ttttacaaaa tatggtcaca
16951 aattctttgg cacccaccc attgagaggt ggcatctttg taccctccct
17001 ttgaattcgg atagacttaa cgatttgctt gcaaacaata aaatgcagaa
17051 taagtggtac acactgagaa gtgtggcttc tcaggctagg tcagaaaagg
17101 tgacacagat tcctacttgt tcactggaat acttggtctc agatccctga
17151 gcctccacat aagtggtctg actaccctga gaatgccatg ttggaaagag
17201 gccaactaac atgtagaggc catctgtaag cactccagtt gctagtctca
17251 ctgagccccc agctgacagc agcatcaact gtcagccatg tgagtgagcc
```

```
17301 attctggaca tccagcctag gtgaaccgtc aggtgacttc atccccagct
17351 gacatctgac tgcagctgct tgagataccc taagtgagaa caatgtgatc
17401 tagcccttct tgaaatcctg accctcaaaa tcataagcaa aacaaaataa
17451 ttgttttaag ccactaaatt ttgaggtaat ttgcttcaca gcaatagtaa
17501 caaaaacaga caaggattag gaaagtatgc cctctgtcac tgctgttatt
17551 taatattcaa ctagaactta tggaccaata agtaaatgaa acgggaggcc
17601 taatgttgga aggaattaaa cacgaccatc gtttgcagac aatgattgtc
17651 tccatagaca agtcaagaga atccactaaa aaaacaatta gaacaaagaa
17701 gagttcagta taagtttaat ttaatatagg aaagacatat aaaaattaat
17751 aactaattag aaaatgtatt tagacaaaag cgccattacc aataacagta
17801 aaaaccctaa aatacttagt aataaagttt aaaaatacat aaaggctata
17851 tggagaaaat gtctaaagtt cactaaaggg cagaatttct aggaatagta
17901 tcatagaaga cattgggcaa tttcttccat agataatgat tataaaaact
17951 ggacaaattt cttaaaaaca actatttgtt ggtgttttg ttagatgact
18001 cttgagaagg gtttactctt gaatgacgga tactgcatca ggtaaaaact
18051 aagagtttgt gaccctaag caggggtca ctccccaaca ccctccagct
18101 ctagtggcag aaaaccacag ccataccagc ttgaggtgtc agagaataaa
18151 gtttaaggca gcagacaact ggatattcaa gggggaatc ctgtaaaaat
18201 gagagccaga gccacagaag gactgaattg aaaagctgag tataagctcc
18251 gctcaaatcc ctgcctgcct gctaaactgc tgagacacac aagagacccc
18301 aggcagccca gtgaaaaagc aagcagagac tagagaggca tctacccttg
18351 tgagacagaa ctgctcctgg tgaggtttgt gagtttgctg cactgttgac
18401 ttaacatgca caaagctcag gtcttgcaga aagcaaaaac cttattggct
18451 tgaggtgcca ctgggcagaa cttggggctg gcagagcaac tggatattta
18501 ggaagaaagc aagggagctg tacagtaggt aagcttcaat acctgaatat
18551 aaattctttc caaatctgtg gctgacccta aactacacag gctcaggaaa
18601 gactcccagg cactaggcca aaaagaagc aactggatcc tgagaaaact
18651 gtgcagaaga atacatcaac tactataaat tgctggggac agatttttca
18701 gtttaaatgc aggcaggtta actgcctact agaacaatat ggcaacaacc
18751 ctcagaagaa caaaacagaa tcttgagtgg gtataacatt actacaatgt
18801 ccagtgtttt ttgttttttg ttttcttgtt ttttttttt gagacggagt
18851 ctcgttctgt cgcccaggct ggtgtgcagt ggcgtgatct cggctcactg
18901 caagctccgc ctcctgggtt cacggcattc tcctgcctca gtctcccagg
18951 tagctgggac tacaggtgcc cggctaattt tttgtatttt tttagtagag
19001 acggggtttt accttgttag ccaggatggt cttgatctcc tgacctcatg
19051 attcacctgc ctcggccttc ccaaagtgct gggattacag gcatgagcca
19101 ctgcacccag cctacaatgt ccagttttaa accaaaaatt actagacatg
19151 caaagaatca ggaaagtgtt actactctca ggaaaaacaa aatcagtcca
19201 tagcaactga atcatagtgg gctcaaatgt tggattcaac agacaaagac
19251 ttcagagcag ctattgtaaa tatgttcaag agttagtaag gcacatgttt
19301 aaagaacata aggaaagtat ggcattactg agtgaacatg taggaaatgt
19351 taatagagaa atgaaaattc taaaaatgaa tcaagtagaa attctcaagc
19401 tgaaaagtat aatagctgaa agttccatga agaatacaaa ggaagacttg
19451 cataaatgga aaggcaacac atatttctag atgagaagtc tcaattgtgt
19501 aatgatgtca attctccaca aatcaatcta ttaaaagcta ccccaattac
19551 aattccaaca ttattttcc accaaagtgt ttaatgaaat ttgaaaacat
19601 gatcttaatg ttcatatgaa aaagagagta cagactgggt gtggtggctc
19651 acgcctgtaa tcccagcact tgggaggcc aaggtggagg atcacctaag
19701 gtcaggagct tgagaccagc ctggccaaca tggcaaaact ccatctctac
19751 taaaaataca aaaattagct cagtgtgatg gtgtacacct gtaatcccag
19801 ctactaggga ggctaaggca ggagaatcac ttgaacctgg gaggtggagc
19851 ttgcagtgag ccgagattgt gccactgcac tccagcctgg caacagagt
19901 gagactgtct caaaaaaaaa aaagtacatt aaaatgacca caagattttg
19951 taggtaaaat atagagggca ggagactttt cctatcaaat acaataacat
20001 taaagatatt cattaaacta atgtgatatt agcaaaagat ccacagatag
20051 aattgtggaa tggaatatag aaggcagaaa catctaaacc cacacataca
20101 tataaatata tgaatttagt gtacaataac agcgatactt caagccagaa
20151 aaaagatag ctcatttaat aaataatgct tattaaattc atctaagttg
```

FIG. 7 CONT'D

```
20201 tttgttatat cggcataaag ttttctataa tatcctcctt gtcagctttt
20251 ctccagcttt actgaggtat aaactgtaca tgattcatgt atacaatttg
20301 gtgagtttgg acatatatat ccactcatgt taccataacc acaatccagg
20351 taataaatat atccatcact tcatcacctc caaaagtttc cttgtgtccc
20401 tttgtttatg ttttttgttt ttctgtggta agaacactaa atttgagatc
20451 caccctttta acacaatcct aagtatgcag tatcttattg ttaactatag
20501 gcaatatgtg tacagcagat atgtggactt actcagcttg aataaatgta
20551 actttatact tttaaagtac ttcccatgtc cctctccccc gatcctctgg
20601 taaccaccat tctgttgtct acttctacac cttcaactat tttcaatgtc
20651 tcacataagg ggaatgatgt agtatttgtt cttccgtgac agacttactt
20701 cacttagtat aatgtcttcc aagtccattc atgttatcac aaatgatagg
20751 gtttccttct tttttttttt tttttagat ggagtcttgc tctgtcaccc
20801 aagctggagt gtctcagcct cccaagtagc tgggattata ggcatgcgcc
20851 accacgcctg gctaatttt tgcttttag gagagacggg gtttcaccat
20901 attaggctgg tctcgaactc ctgacctcag gtgatccacc agcctcggcc
20951 tcccaaagtg ctgggattac aagcataagc caccacgccc agccctgggt
21001 tttcttcttt tttaaagctg aatatgccaa gtgcagtggc tcgcacttgt
21051 aatcccagca ctttgggagg ccgaggtggg cagatcacga ggttaagagt
21101 tcgagaccag cctggccaac acagtgaaac actgtctcta ccaaaaatgc
21151 aaaaattagc cagatgtggt agcacgtgcc tataatccca gctactcagg
21201 aggctgaggc cggaaaatca cttgaaccca ggagaacaaa aatgagccct
21251 tggacattta aaatataaca gcagaagtaa atattgtgat ggaaggattg
21301 gaagataatg ttgaagaaat ccagaaagta gagtgaaaag caaaggtgt
21351 aagaaggaa agaaaatatt tttaaaatta gagactaagc agaatgcaac
21401 aatcaaataa taggagttcc agaaaaagag aacattaaaa atggagtgga
21451 ggccaggtgt gatggctcac atctataatc ccagcacttt ggggagccga
21501 ggatggtgga tcacctgagg tcagaagttc gagaccagcc tgggcaacat
21551 ggtgaaaccc caactgtact aaaaatacaa aaattagccc cgtgtggtgg
21601 agcatacctg tagtcccagc tactcaggac gctgaggcag gagaattgct
21651 tgaacccagg aggcagaggt tgcagtgagc ttgatcatgc cactgtacac
21701 cagcctggt gacagagcaa aaaagctatt actgattaag cacattatac
21751 attatatcta cattaattta tttactcctc ccaacacctc tgagaggtaa
21801 ttttttgtc cccatttata gatgtggaaa ctgaggctac ataagattaa
21851 gtgccttgcc tcagactagt tttgttgttt ttgttttttt aataaataga
21901 cacagagtct tgctaagtca ccaggattgg tctcaaactt ctggccttaa
21951 gcgatcctcc tgcctcaggc tcccaaagtg ccgagactat agacataagt
22001 caccacacca accagcttag tttttttctt ttcacttcta aatattatat
22051 cattttgtca agaactactt ttatatatgt gaaaagggat caatacaaaa
22101 gctaagaaag aagcaagcac aactctattt ttatttattt atttatttat
22151 tttgagatgt agtcttgctc tgttgcctag gctggagtac agtggcacga
22201 tctcaggtca ctgcaacccc cgcctcccgg gttcaagtga ttctcctacc
22251 tcagcctcct gagtagctgg gattacaggc gcctgccacc acgcccaact
22301 aattttgta ttttagtac agttggtgtt tcactatgtt gcccaggctg
22351 gtctcgaaca cctgacctca agtgatctgc ccaccttggc ctcctaaagt
22401 gctgcgatta caggtgtgag ccaccacacc cagccagcac aactctttct
22451 agaagggaag aatgacattg ccactattgg atgaagactc ccaggagaag
22501 atgatgaggt gaagagagtc tctgggtcag agtctgaatt tcactcccctt
22551 gggagcctta caagagcccc ttctggggag gaccgtggac aaagccatat
22601 cttaggaagg ataggcctca gcatattggg gcaatattga cagacccttta
22651 gtgcaggccc agctctatcg tccagcagga atatggcctt gggaatgaac
22701 tactgtgcgc gatctacttc aagacacagc tccagtctca tgagtgagca
22751 aatcagaata cgtcttgcgg gttgaaggga gaatccttag ctggtcgtgg
22801 ctgtggggcc tggatcctgt gctgatgaag tttctccctt cccccttcatg
22851 caaaataaat actttgctca ttgatgcaca gggtaatggt aagtcatctg
22901 ggaaatccag ccaagtcaca agcactaatc ttagtttcta actatgaagt
22951 gaccttccaa cctccttcct aatcaagtta ggttttttg gtttgttttt
23001 cttttttcctg caaagtaaaa atatccagtt caggaaatgt ggctgattga
23051 atagcagctg ccatggagga cctactttgg atattgaaac aaccttggaa
```

FIG. 7 CONT'D

```
23101 gaagatcaga aactcactcc catcagctcc tgttttgagg caggcctgga
23151 gctcatcacc cagattagtc ttggcctcca cattgtcctt cctgtatatt
23201 tttaggagaa agtatctggc cactgtttct ttttcctctc aatgctagga
23251 aacttcctgt aatattggaa aagtagaagt tgaagcggct tcagtgcaaa
23301 actaacattc tctggatctt tctcacgctg ttcggaaagt agatcaccca
23351 ctgttatttc cttttcctgg cttttttttt tttcctaaca gacaaagaga
23401 ggcactgcca cgatactatt tctgttcaga gggggagaga gagcaaaaag
23451 agacaggcag aaacattttc cccagccttg ccacattctt cactcagtta
23501 taaagaaacg cattgccaat aaaatagaaa acagaaatag caggaaaatt
23551 ctgaaagatg agctgtgctg taaatgtaaa acacaagcca cttaatgcat
23601 aatcattcaa aggacagttt gtaatgaaaa taaagacatt tcaaaagagc
23651 ccataatttg cttacattac attctgtatc taattgttat agtatgtttt
23701 attcctctta tacaagaaaa aatgttgacc tccctcattc atatggcatg
23751 cagatgcatt tgagcagggt ttttgggtt taataatgtg atagactggc
23801 tggcactca tgcctgtaat cccaacccctt tgagaggctg gcaggcagat
23851 cacttgaggc caggagttcg agaccggcct ggccaacatg gtgaaacact
23901 atctctacta aaaatacaaa aattagctgg gcgtggtggc acatgcctat
23951 agttccagct acccggaagg ctgaggcagg aggctgagct tgggaggcag
24001 gaggctgagc ttgggaggca ggagactgag tttgggaggc agagggctgc
24051 agtgagccga gatcatgcca ctgcactcca gctgggtga cagagtgaga
24101 ctccatctca aaaatatat atatgtatta tagaatatta gagctttaga
24151 catcacctag tgcaaacttc ttgctttaca gattagaaaa ttgaggctta
24201 gaaagtctaa gtaatggcca agcacagtgg caaatgtctg taatcccagc
24251 cctctgggag gccaaggcag gaggattgtt tgaagccagg agttcaagac
24301 cagcctgagc aaaacagaca gaccccccca ccccaatctc tacaaaaaaa
24351 aaatttaat tagccaggtg tggtggcatg tgcctgtagc cctagccta
24401 gctacttggg aggctgaggc aggaggactg tttgagccca ggaatttgag
24451 cctgcagtga gctatgattg caccactgta ctccagcctg ggcaacagag
24501 cccgacccta tatctaatta ataataacaa aaagattaaa taacttaacc
24551 caggcaacac agatggaaag tagcagagct gggggctaga atccagatct
24601 aaatcttcag cctgcattct tcctaattta tgtggagcct cacactgtct
24651 tgccctgtcc catgtgcaag atagcagccg agaatgacta ctgcagcatt
24701 ccttctgatt tccttatttc tgacttgaat atgctacacc agtaacaaaa
24751 ctatgagcac ccaagacaca accacacgca tgtgcacaca cagagacgca
24801 cacacatact gttaacagat actgagacaa agatcttgga agacagcatt
24851 gtcttctgaa aagagaatct tctgctatgg aatgtctggg aaggaagtgt
24901 gacagacgtt ttcactcacc caacaccttt cccactttct tcttgctaca
24951 agtagcataa ttttattcag atagcatgga gtgggggcag acagggtggg
25001 ggcaatgcgc tcagagaagg tagacccagc ctggccaagc caagtaattt
25051 tattctcctg gtcaggaaga tgtatggaga aattggctgg taggcttag
25101 gaaaacattt cattttttat tacacaaatg cacacacatg cacacaagca
25151 gccaaaaaca cttacacctt tcccttctt cctgccttt ttttttcttt
25201 gagatggagt tttgcttttg ttgcccaggc tggagagcaa tggtgcaatc
25251 ttggcttact gcaaccctct cctcccgggt tcaagtaatt ctcctgcctt
25301 agcctcccaa gtagctggga ttaccggtgt ataccaccat ggccagttga
25351 ttttttgta ttttcactag agacgtggtt tcaccatgtt ggccaggctg
25401 gtctcgaact cctgacctca agtgatccac ccactttggc ctcccaaagt
25451 gttgggatta caggcctgag ccactgcacc tggcctcttc ctgcctttca
25501 attcagtttt gtgagaataa gatatttgat gttgctgcac aacattgctg
25551 gggagtcatc acacctaagt tgacagtgct gaagcagaaa catggaaaga
25601 gaccggctct ttgatgacac ttgagctgcg aaactgacct ggaatgacct
25651 ccttccagat gtattgtcat gagagagaat aagacaatct cattgtttca
25701 gccacttgca gtgggtgttt tataacttgc agctgaaagc atagttacct
25751 ctctgagcct cagttttttc ctttagaaaa tggcgataac actacttacc
25801 cagcaggtcg taggaggaaa tggtataata caatgcctaa cataaggaa
25851 ctcagtaaat cgtagctagt catatcataa tcatgataac cctcatagca
25901 aaatcctcag tggtgggaat gttttctcca ctcgccagt gtcatggcat
25951 cgggttgctt ctccctacag tggtggtctg agacagtttt gccccgctgc
```

FIG. 7 CONT'D

```
26001 cacctcttct ccaagtgctg aggagctcag gcatgggagc tttgggcctg
26051 ggagctttgg gccggggagg tagggagtcc agtctgtaaa ggaaaacaat
26101 aaaaatgaaa agcaagcatg taaaatcata ataacatatt gaataatctt
26151 agcaagccac aaagtgttct ttattttta tttatttatt ttttgggac
26201 ggagtctctc tctgttgccc aggctggaat gcagtggcat gatctcagct
26251 cactgcaacc tcccctccc gggttcaagc aattctcctg cctcaacctc
26301 ctcaggaact gggattacag gtgcctgcca ctgcacctag ctaatttttt
26351 gtattttag tagagacggg gtttcaccat gttggctagg ctggtcttga
26401 actcctgacc tcgtgatctg cccgcctcag cctcccaaag tgctgggatt
26451 acaagcatga gccaccgcgc ccagccaagt gttcatttct tatgtcccag
26501 aagtcccaac tctggcaatc tagcccatag aaataatcca aatgaagaga
26551 gaaattttac tcaccaaatc tttaattcag attttttgc agcctttaga
26601 agtaaataat aatatatccc cttgatataa tataattatg aagccaacac
26651 agtaatgttt attagaaact atgtaggggt ggcccggcgc ggtggctcac
26701 gcttctaatc ccagcacttt gggaggccga ggcgggcgga tcacgaggtc
26751 aggagatcga gaccatcctg gctaacacgg tgaaaccctg cctctactaa
26801 aaaatacaa aaaattagcc gagcatggta gctgtagtcc cagcgactcg
26851 ggaggctgag gcaggagaat ggcatgaacc cgggaggcag tgtttgcagt
26901 gagcctagat tgcaccactg cactccagcc tggacaacac agcgagactc
26951 cgtctcaaaa aaaaaaaaa aaagaaact atgtaggaat aaggcaatgt
27001 aattcttaat ataaattaaa tgaaaacaaa atcagaatac aaaattgtat
27051 gtgtgctctg cttacaacca cgtggagcac agctataatt aaagcgggct
27101 atacttggca cactgattgt taaataagtg cagcgaacac aggaaataag
27151 ggggctgcgg gttgttgaag aaactggcca gaaaacggaa cgaagaggag
27201 agaagctaac ggtgctcatc gtgtggcacg caggtgcgtt gttttctctc
27251 cactaaggct gctgggtggg gccaaaatag tccaggcagc caagtgcaga
27301 ggcgttgggg gcggcaaaga tgcaaggat ccccactgtg gctgcacccc
27351 gaggaggagt ccgtggcagg aggcccacac ccaggacccg gcgccaacag
27401 tgaggagacg aacctggaag acatcccgct gtccagacac cgcgagggag
27451 gcgagtggtg ctcgcagcct gggacttagg aacacaggga aacagcttcc
27501 acatgccatt tgctgaataa atatttcttg caggatgttt cctatggatt
27551 cattctctat catgaaagct ttatttgtgg tcagcgtcct aggaaagcag
27601 aggcagacag atttctgttc tagggagttc tgtggagggt tacagatcag
27651 caatattcca ctgaaaccaa ataccatgga aaagcatgga aggacacaca
27701 gaaatcacaa attattatat tatattatac tatactatac tatactaata
27751 ttatattata ttatattata ttatattata ttatattata ttatattata
27801 ttatatattt attttttgag acagggtctt gctccgtcat ctaggctgga
27851 gtgcagtggc gcaatcatgg cttactgcag cctcaacctc ccaggtgcag
27901 gtaatcctcc tgcctcagcc tcctgagtag ctgggactac agctgcatgc
27951 catcacaccc gactaatttt taaattatat agttgtagac atgggttctc
28001 tctatgttgc ccaagctgat cttgaactcc tgggctcaag caatcctcct
28051 gccctggcct cccaaagtgc tgagattaca ggcatgaacc accgtgcctg
28101 gccaaaatgt atattttaaa aaacatataa aatagagtt ggctgggcgc
28151 ggtggctcac gcctttaatc ccaccactt gggagaccga ggctggtgga
28201 tcactaggtc aggagatcga gaccatcctg gctaacacgg tgaaaccccg
28251 tctctactaa aaatacaaaa attagccagg cgcggtggcg ggcacctgta
28301 gtcccagctg ctggggaggc tgaggcagga gaatggtgtg aacccgggag
28351 gtggagcttg cagtgagccg agatcacgcc actgcactcc agcctgggca
28401 acagagcgag actctgtctc aaaaaaaaa aaaatagagt taataaatat
28451 atctatgtgt tatagatata aataaatgt gtttgcaatc attatctact
28501 gtgtcctata actaattaag atcttcaccc ataaaaatcc caaccctatt
28551 atgaatttgg agtactttct ggtggtggac tcacactttt tcatgcaagc
28601 tcctttgccc cctatgcaac cactgcccac gttgtgctcc agggcagacc
28651 atagttcaca ggcggaagca ggtgccatgt aggaatgaga ccacatgtac
28701 catgaagcaa cggagctcac tgattcagag gcaagatgct ggcccctctg
28751 gctgtcacca tggatgactg ctgatttaag gtcttcttg gtcatcccac
28801 ctggcaccac cacttctggt cccttctctt cagtttcctc tacccagcta
28851 tgtcctcctc tactgataag ccctgaaaca gagcaagtgg cctcttttt
```

FIG. 7 CONT'D

```
28901 aatgtaacaa atattttaca atattcattt gtaaagtcta gaaatgaaaa
28951 taatacacaa tagcatctac ctagccacac aatcttgaaa aacaatcagt
29001 ataatgctgt aactataacg taagaaataa atgaaggtat ttatttattt
29051 atttatttat ttattttag agacagagtc ttgctctata gcccaggctg
29101 aagtgcagtg gtgcaagtgg tgcagcctcg aactcctggg ctcaaatgat
29151 cctcctgcct cagccttctg agtagctggg actagaggtg tgcaccacta
29201 tgcctagcta attttaact tttttgtaga gactgggtct tgctatgttg
29251 cccaggctgg tcttgaactc cttgttgagg atcagtggga gatgaaaggg
29301 aggagagaca gtgaggaccc cttggcacta cccaccttcc ctacccaccg
29351 gcaagtcccc aatgagtgat gtccagtatg ggtctgggcg gggcaagtga
29401 tcctcctgcc tcagcctccc agagtgctta aattacagat gtgagccact
29451 ctacccaacg gaaggtaatt tgaaataaaa taatacatgt tcccatacat
29501 aagtgctcag gacaatcaca ttaatgaagt tgtcacgttc ttgcatctaa
29551 atttagaatc cacatgagca ccatggcagt ggatcgccgt tttggtgcgt
29601 cttatcagca acttaaatgc cacgctgtta ttcaaagcgc tgctgtcagt
29651 gatgtgattt tccaaaataa tgagcagctc ttggaaaagc tccaaacaga
29701 acaaagtgca aactttcctc aatgcataca gtagttgtgt ttctggaaag
29751 tgtagtgtat atgaaaacca catgaaaata gtctgcggtt acatataaaa
29801 caaaattagg ttctaggatc agatagtttt tattttattt tattttattt
29851 tattttattt tattttattt tattttattt tattttgag acggagtctc
29901 cctctgtttc ccagcctgga gtgcagtggc acaatcttgg ctcaccacaa
29951 cctctgcctc ccaggttcaa gtgaatctcc tgcctcagcc tcccaagtag
30001 ctgggactac aggcacgctc cactatgccc ggctaatttt tgtatttta
30051 gtagagacgg ggtttcacta tattggcgag gctggtcttg aactcctgac
30101 cacgtgatcc acccgccttg gcctcccaaa gtgctgggat tataggcttg
30151 agccaccgag cccagcccag atacttttta aatggtgttt ttttcttta
30201 aactactaca taaatgtttg ggacattcaa aagtgaaatt caaatttaag
30251 aaacattttt ttcttgcaca aaatattctt gggtgttata ggatgtctag
30301 catctctagt ccccactcac tgaatgtcag gcacatgctc aaatcaaact
30351 ctccaagagt ggtcattgag aactactctt tcctgtatat gagtagacct
30401 tgtactctct gtccacttt ctccacatct ggggaaagct gaatcatggg
30451 cataagtacc tgtaaacagt cactgataca catgttacat ctgtagcaac
30501 caccccaaat tcagatatat agcttagggc cccatgggtt gcctaataca
30551 tgatggtcat agagggagga aatttctcgg agaatttcat tcaaccttca
30601 gcatgattgg agcattggtt ctcccacag tacccacaaa ggtaacttgt
30651 accccaccca gccccatctt gtacatcact cactggggac ttggtggtgg
30701 gtaggaaagg tggatggttc ctagggttcc tggctgtctc tcctcccctt
30751 tgtctcccac tgatcctcaa cacagctcat ggctgagaac ttctgattga
30801 gagatttata caagaaattg cattcctcaa agtaagtgat tattgaggga
30851 aaaaaaagg aaaaccatga aaaaaccccc aatgcaccct acttgcttat
30901 atgtgcgtag aatatctctg gaaaatgtc taagaaacca atggtgtgag
30951 ctgtttccca gggagggtct ggcatggctg gagcactgcg gtgaaaggag
31001 aacgtccttg atgctctact cttttgtacc ttcagaattt tgtatggatg
31051 gcttgaaaat agaaagaaat agaatttgat ttttaaaaga ggcagtccct
31101 ggaaaaagt tattaatttg catattgcaa gttgagaaag tgagagacca
31151 gagcaagagg aggtcacaac aagataaaaa ggtgggggcc gttatggagc
31201 ccagggaaag gagggctgga caagagactc cgtccatgtt tctctagcac
31251 tttccaggag aataaagctc ttgttctagc actctcctcc tttggaccta
31301 tctgtagaga gcagaaaagt gaccacgagg ctctgttgca tgataaacaa
31351 ccccttaaaa accaccaact ttccatggtc ttccagcaac ccatttggat
31401 gtcgtcccta cagttgactc cttcagtccc tgtgtgtgtc ctctgcgtgc
31451 ccctggcccc ctgccttccc ttagctgtgc tgcacagaaa accgccccag
31501 ctcttgggtc aaacagatcc cataagaaac atcagaagaa gcatcctggc
31551 ttacaagtta ttttttggtg agtgcaatgg gcgtgccgtg ctcctccagg
31601 cctgaccacc tgtatgagag ttggcaggag acatttcta aactcacact
31651 cttagggcag tagagatggg gccaagacc tttgtctctc ctggtatcag
31701 tgagcccgt gtagccccctt ttccttattc caggtctgga agctgcagtc
31751 acagacacac aaaggtgctg gggcttgcac attcaccagc gtcactttct
```

FIG. 7 CONT'D

```
31801 ccagccacac cactacgttt gagggctctc ctgtccttct ctaacagaac
31851 tagtctggga ctagacgcca ggctttgggc taagtacttg atgtgtcttc
31901 acttattaaa tccttccaat aacccttcaa gttaggtacc attattatcg
31951 tcatcaacct cattttatag agaaggaaac tgaggtgcag agaaattcag
32001 gttgaggttc acagcaaata agcagtggag gccaagtgtg cccccaggtg
32051 gacccaaatc aaagccacac tgttaccttc tgctctgcgc tgcctcccgg
32101 ggcagtagcc ctcgtgagcc tccccacgtt ggggtgtcta atgaaaagct
32151 tccctgctgg ttgagctgaa ggggtcaggg tcggggctgt acagagaaac
32201 tcaggccaca agggcctttg gcagaactg gggtcacaaa gtaatcatgg
32251 tttcccagcg aacacaagac tttggccctc aggcaaggct ccttgatgtc
32301 tggggagcc tgtgcccccc agcagtgctc acagatccac ccctgactgc
32351 cagccggccc cttgatggcg gtgcctgtct cagattctgt ggtcagtgcc
32401 acgcagctac ctccagaggc agcctgcagc ctggccatgt ggccccaagc
32451 tccaggctag aggccaaggg gagtgtccct tctctctctg tgtcacccag
32501 ggcataggtc acccaggcag cctggcatgg tgcctccaag ccactgtgct
32551 aatgcttcta cagcttctgc tccctccctg cctccatggg gcccaaacct
32601 agccctggtg ctgctctggg aactgggtca gagcagcacc ccagctcccc
32651 cacccccagg agcccctcaa ccttggcctg ctgtcatcct cgtccggccc
32701 caatcttcct gcaaatcggg cccttgcagg attcctgctg actcagcagc
32751 tgggcccgga caggacttag tcccagcgtg agccgatccc gctgcagttt
32801 gggcgagaat gacaagccct ccaccagacg attctttatt gctctgagac
32851 ttccctggga taattccacc cccaggagca ctctatctgt ttctgtctcc
32901 tccccacaca cccctggcc ttgaaaaagg atgatcactg accacaggca
32951 ctgaaaagag caaaccaaga gcagcatcaa taccctcaca cagtggtgca
33001 cataacacac tttgagtttc tgacttttcc taatcagttc ttcctgctaa
33051 aatacagtag cttaacaaaa acaatgacaa caacaatctg gtgtttgcca
33101 tttacaaggc actttctgtg tgagtagcat gacatggtaa aagagaaaga
33151 gatgaattat aaaacgcagc aagatcatga gtcaatgatt caccctgtcc
33201 cagcctgctt cttttttttt tttttgaga cagagtcttg ctctgtcacc
33251 aggctggagt gcagtggcgc gatctcagct cactgcaacc tccgccttcc
33301 gggttcaagc gattctcctg cctcagccac ccgagtagct gggactacaa
33351 gtgtgcgcca ccatgcccag ctaattttg tatttttagt agagatgggg
33401 tttcaccatg ttggccagga tggtctcgat ttcttgacct tgtgatctgc
33451 ccgcctcggc cttccaaccg agcctgcttc ttttcttgta aatggaaga
33501 gtcataacat ccaacttgag tcttgatatt ttaatgaaat aatgcatggg
33551 aaagcagaaa acagcacaaa gattactggt tataagagct aaatcactgt
33601 gactccatat ccaaattcaa tacctactga atcagtggtt tctgactagt
33651 caatttttt tctttttttc tttttttt tgagacagag tctcggctgg
33701 gtgcagtggc tcacacctgt aatcccagct ctttgggagg ccgaggcggg
33751 cagatcactc gagattagaa gctggagacc agcctggcca acatggcaaa
33801 accctgtctc tactgaaaat aaaaaaatta ccaggcatg gtagcacgtg
33851 cctgtaatcc caggtactcg ggaggctgag gtgggagaat tgcttgaacc
33901 taggaggcgg aggttgcagt gagccgagat tgtgccattg cactccagcc
33951 tgggcgccag agcgagactc catctcaatt aaaaaaaaa aataggagag
34001 agacagagtc tcactctgtc ttctaggctg gagtgcagtg ctgtgatctc
34051 agctcactgc agcctccacc tcctgggctc atgcagttct gggcctcaa
34101 tctcccaagt acctggaact acaggcacac atcaccatgc ctggttaatt
34151 tattattttt tgtagagacg tggtttcacc atattggcca ggctggtctt
34201 gaactcctga gcttgagcga tcctcctgcc ttggcctccc aaagtgctgg
34251 gattacaggc atgagccccc atgcccggcg actagccaat ttttaaaaa
34301 ttacattttc tagaggtgtc attttactg gaaaaacac agtgacacca
34351 ttcaagaaaa aattgaacgg taactttaat cactacatta acacaatttt
34401 aaaggttgat ctgcatcata catacctttt aaagaatgtt ttcatcatat
34451 gtagacagct ttttttgttt tttgttttg ttttgtttt gaggcagagt
34501 ctcgctctgt caccaaggct ggagtgcagt ggtgtgatct gggctcactg
34551 caacctccgc ctcccggtt catgccattc tcctgcctca gcctcccaaa
34601 tagctgggcc tacaggtagg tgccaccacg cccagctaat ttttgtattt
34651 ttagtagaga cggggtttca ccatgttagc caggctggtc tcgaactcct
```

```
34701 gacctcgtga tccacccacc tcagcccccc aaaatgttgg gattacaggc
34751 ctgagccacc acgccctgcc ataggcagct tttaaaagaa cacatgtgca
34801 gcctggccat catggtgaaa cctgtcttta tgaaaaatac aaaaatcagc
34851 tgggcatggt ggcacctgcc tataatccca cttgcttagg aggttgagga
34901 gggaggatcg cttgagccct ggaggcggag gctgctgtcc agcctgggcg
34951 acagagcaag actcggtctc aaatagaaaa caaaacaaaa caacaacaac
35001 aacaacaaca aaccatgtgt gattccaagc aaatcagaga atctctagcc
35051 accagaaaaa ccttgaggca tgtactgaaa ggaagaggtc agaattctct
35101 gcgaggagct cagaggatcc tgagggaaga gagaaggcgg ctgcgcttgg
35151 acacagctcc gagctcgtgc tccctccttc aggcacccaa gtctgagttg
35201 ctaaaaaatg gagctgtcac tgggccttgc tctgccagga cctgcagagc
35251 cggggacctc tctgtggcaa gcccagcaag atgactgctc tgaggcgccc
35301 tagggctgag ggaggggccg tgacaccagc ccgcccccc agccacctgg
35351 gaaaaggaag cacaaaaagg agaagcagca acggctgctc tgcttccttc
35401 ccatctcgct cttgggtcat gcctggccag cagaaagcag ctccataggg
35451 gaggagagcc acgcaggatc tcacagctgc agtctaatag taacacagag
35501 gtaattttaa ctttttactt ttctaccctt gggagtaggg atgagtagag
35551 gcttacctcc ttccagaggc agctcatatc ccccaccccc cattcccgga
35601 agttgagatg tctcttctct gttccacgca ggcatcgtct aagtttgggaa
35651 caggtcttat gtcttaaaat tgggattct ttaaaaacat atgtggctgg
35701 gcacagtggc tcacgcctgt aatcccagca ctttgggagg ccgggcaggt
35751 ggataatttg aggtcaggag ttcaatacca gccaggccaa catggtgaaa
35801 cctcgtctct aatataaata caaaaagtag ctgggtggta gtagtagctg
35851 taatcccagg tactcgggag gctgaggcag gagaatccct tgaacctagg
35901 aggcggaggt tgcagggagg cagaggttgt gatgagccaa gattgcacca
35951 ctgcactcca gtctgggtga cacagtgaga ccctgtctca aaacaacaac
36001 aaaaatgtgt gatggcacat gcccatagtc ccagctactg ggaggctga
36051 ggtgggagga tggcttgagc ctgggaagtc gaggctgcag tgagctgtga
36101 tcatgccact gcagtccagc ctgggcgaca gagtgagacc ctgtctcaaa
36151 acaaaacaaa acaaaacaaa acaaaaaaac ccaaaaacaa acaaaaaagc
36201 acatgtggag tgttgtagaa gtcattgacc ttggtaagac agtggaggaa
36251 actgctttgc tctgactcat aaatttgccc ccagtaaaca gtatttataa
36301 atagccccag tcaggcactg catgaagaca tttcagtcaa cgacagacca
36351 catatacaac ggtggtccca taagattata acagagctga aaaattccta
36401 tttttcagct tagtgttgtg gtgcaaccac taccttttct atgtttagat
36451 acacgaatac ttagcactgt gttacaatag cctacagtac ccattacagg
36501 aatgctgtac cggtgtgtag cccaggagca atgggccata ccatatagcc
36551 taggtgtgga gtagactaga ccatccacgt ttgtgtaatt acaatctatg
36601 attttgtaaa atgatgaaat tgcctaatga agcatttctc agaatgtgtc
36651 cccgtcatta agtgacacct cactgtgttt ccaagacata gtactggtcc
36701 ttgggaagct ctaaagagag gtcaccgtga gctgaaccat ccttctcact
36751 ctgtgcatgg aacccagctt agcttccatt tcagcattta ggcttatagg
36801 aggagaagag gttagaagcc acagaccagc aagaattgaa gacatcgttc
36851 tgtaatttct actgaaccag ctctgtctga ctggaacttc attttgcctc
36901 tttgctttaa ctcctcagga atgtcttcca ggaggcccct gatcttctct
36951 gctcagggac cactcttatc tgacccagag acaggttagc tgatggtgac
37001 tcacacatcc tcacttcctt caaagcccag gcatctgttt aaaatctgac
37051 cctgtgaaga cttttcctgt tttggaaaaa ctcttccgtt gtttgcctgc
37101 acagatttgt gctccatttt taatttcaat ttttgtagag aaggcgggtc
37151 cttgctttgt tgcctcggct tgtttgaaac tcctgggctc aagtgatcct
37201 cctgccttgg cctcccacag tgctgggatt acaggtgtga gccactgcac
37251 caggatggat ttgtcttcct tcagaagaca gtagctgatg tgtgccctgg
37301 cctttctccc ctaggattca gcagtggcca ccatgggttc tgtgaattcc
37351 agaggtcaca aggcggaagc ccaggtggtg atgatgggcc tggactcggc
37401 gggcaagacc acgctccttt acaagctgaa gggccaccag ctggtggaga
37451 ccctgcccac tgttggtttc aacgtggagc ctctgaaagc tcctgggcac
37501 gtgtcactga ctctctggga cgttgggggg caggccccgc tcagagccag
37551 ctggaaggac tatctggaag gcacagatat cctcgtgtac gtgctgggaca
```

FIG. 7 CONT'D

```
37601 gcacagatga agcccgctta cccgagtcgg cggctgagct cacagaagtc
37651 ctgaacgacc ccaacatggc tggcgtcccc ttcttggtgc tggccaacaa
37701 gcaggaggca cctgatgcac ttccgctgct taagatcaga aacaggctga
37751 gtctagagag attccaggac cactgctggg agctccgggg ctgcagtgcc
37801 ctcactgggg aggggctgcc cgaggccctg cagagcctgt ggagcctcct
37851 gaaatctcgc agctgcatgt gtctgcaggc gagagcccat ggggctgagc
37901 gcggagacag caagagatct tgatccagac agagcagcat atctttgctc
37951 atacaaacta gaagaaccag ctgatccttg agaaatttac gcttagtcta
38001 tcaaacaaga aatgctggct tggcccggtg gctcatgcct gtaatcccag
38051 cactgtggga gaccacggtg ggggaatccc ttgagcccag gagttggaga
38101 gcaacatcac aacacccat ttctactaat aatcaaaaaa ttggccgggc
38151 atggtggcat gtgcctgtag tcccagctac ttgggaggct gaggcaggag
38201 aatcgcttga gcccaagagg tagaggttgc agtgagccaa gatcgcgcca
38251 ctgcactcca gtctgggcaa cagagtgaga ccctgtctca ataataataa
38301 taataataat gatgatactc taagaaaaaa atctcaacat acttcattta
38351 atagctcgtt accaagtgtg aatgaagcaa tatgtcataa tagagtagcc
38401 actggttgca taataataga gacctaaatt ctcaaatagg gaaagaggtt
38451 ttaaaatcaa atttgaggcc aggtgcagtg gctcatgggc ggaggagggc
38501 agattacttg aggctaggag ttcaagacca gcctggccaa catggtgaaa
38551 ccccatctct actgaaaata caaaaattag gcatagtggt gcacgcctgc
38601 agtcccagct actcaggagg ttgaggcaga agaatcgctt gaacccagga
38651 agtggaggtt gcagtgagcc gagattgtgc tgctgcactc cagcctgggt
38701 gaaaaagaca ggctgtgtct ccaaaaagaa aaaaaaaagt caaattcaaa
38751 tatcatctgg acatgtcaca atggatcgcg gatccttatg agtgattttc
38801 cccagtggcc cctggggatg tgccactgtc actcagaagg gcaagctagg
38851 cagggcccat acaacagcag gggtctgcag gttagacgtt ccctgccctg
38901 ggacgctcac ccctgggcaa gaggctggaa gttcacacca tccaaaattt
38951 atccttgttt tttttctgat gctaattagc ctctcccgat tttatgacat
39001 cttgtgttga tcttttttcaa aaactcattt tcttttttt ccttctcttt
39051 tctccttctt gtagcacata tctttcgtta aagatcagat caataaaata
39101 ttttatttat tcattaattt aacaaaaaaa acagagcatt tagtttgtgg
39151 caaaaacact gagctttcga atatgaatca tgtgctttag gtgggaattg
39201 tgaattctga agatacagat gacagtgacg aatgccttct gtctcatgat
39251 tgacagggaa aaggaaggtt gaccatagca tcctagaagg ctcatcaggt
39301 gatcattacc tagcatccat gaagcacctg aaattatttg caaaatgtta
39351 cgctttggac catttttccg gggaaggaga tccagaactt tttaccagat
39401 tttcaaagac atctgtgact cccaaaagtt aacaatcact gatgtggttg
39451 ttgtatccct catccaaccc cagaacactt tctgtaatct gagtttttta
39501 atggcaagtg gcctatattt agcacctgtt ctcatgttaa acagctctga
39551 atgttagata ttctttctta tcctggactg gttctctcta tctctggagt
39601 aatgcagtat aaattggcca tcagtaccct cctaaaatct gagatctgcc
39651 aggcccctct tctaacacca ggttaggcat gcttggttat ttccagtact
39701 tgtcagtcaa catgtttcaa gacgctgtgt tagacactag ggatgcaaag
39751 atgaatgaga taaggcctca ggcctcatgg aaggtgagac agtaaagaca
39801 ttactcccat aaaaatgtga ggagagagac tcagttcagc aactgtttat
39851 tctgtttatt gagcacttac ttggaccaag cactgtggtc ttggtgtttt
39901 acatagactg tctctaattc tcacaactct gcaaaatata tatattccca
39951 ttttataaaa ctacaaactg aggctcagag aaggtgtgac ctcttgttgc
40001 tgaggcaca gagttataaa gtaacatatc tggaatttga aatcagatct
40051 gtttagggct aatgctgcat ttttctacaa catcatgcct ctagaaggtt
40101 taagctaggt aggctttcag ccagcagaca tgatggggag agccttctaa
40151 taagagggaa gagactgctt ggaagcatga agggaggtgt aagaaagata
40201 agtaagtcag tgtacttgca acagaggctt gggatgaagg gtgggtgaag
40251 ttgacatcac gatagaaaac aaaactggaa tgggagttta ggtccaattt
40301 gggcaaggtt gtttgaattt caataatcag gggtttgggt caaggaagaa
40351 aaatcatggg acttgccatt taggaggata attttgtggt agtgtggagg
40401 tgaaataaag agaaagggga accttggagc tgggaaggca ggaaccggc
40451 tagatgacca tcacacagca aaggagggag tggaagagag atgagaaaat
```

```
40501 tgagagctat tattaagaaa aacagttgag agaggaagaa tttgaagagg
40551 gctcaagatt ttgagtccac atgacagaag gactggaatg ccatgaactg
40601 gagaaggtga gcgctgaaga accaggatgg gacggggctg gaacagctgg
40651 gttcagcttt tgcagggtgg gtacgtgttt ggttatagct gctttcagat
40701 tgttccatta tctgtactcc caacaaccct gccggatata tttgttggct
40751 ttcactcatg gaggctcatt tccttgcatg atttgtcact tttgattgtg
40801 agctcatctg cagtaggagt tgtttatcct gtgtgactcc catgtgccct
40851 ggtctgtaac aacatttcta cagagtggta tctactagga tcctggggat
40901 ttcaattatt ttagaccaaa tattatgtca gtttctctgc ctggggctac
40951 tggacctcag aggtagtata catctgaact gtgtacccat tcaatgcaca
41001 ggccttaggg attccatatg tgacaggtga ctttttttcc ttgcctttat
41051 gttgtaagac agacagcctg cctcctcaga cttccctgag ctggtgggca
41101 gcattttttg aaccctcttt taaggagggg tcatctctct gatgctcttc
41151 tttttgctg agctcagatt aacatttct acctgggtgc agtggctcat
41201 gcctgtaatc ccagcacttt gggaggccga ggcaggcgga tcatgaggtc
41251 aggagatcga gaccagcctg accagcatag tgaaaccctg tctctactga
41301 aaatacaaaa aaattagccg ggactggtgg cgggcgcctg taatctcagc
41351 tacttgggag gctgaagcag gagaattgct tgaacttggg aggcggaggt
41401 tgcagtgagc caagattgca ccactgcact ccagcctggg caacagtgcg
41451 agactccgtc ttaaaacaaa caaatgaaaa accattttc tctcctccaa
41501 gcaagcctaa ggccacatgt cctattctca cacaggtgct ttaatttcag
41551 cccagtctct agagcctaaa tttggctcct ctgcaatttc catgggctct
41601 aggtttccag cttatactta ctgctttggc tgtggtttct ctcttccatt
41651 tctaccacgt gaggatttcc ttttatttg tttaaagaca gcacacatta
41701 aaaaaaactt ttgttgttat cgtttaccca acatttctat gtttttttt
41751 catgggaagg ccatctgcca taatgctaga agtcctgaac ttgtttttgat
41801 atgtgaccct gagccttccc ggggtgctgg cagaatggtg acatgattag
41851 atctgttctt aggaagatat caggggcagc agcatttggg tagaggtagc
41901 atcctgaagg caaggagaca ggttaaagaa agaccagagg tgtcttttga
41951 cccaggtaga cactactgac acattggtct gcgcaaacag ttcaccacag
42001 ctgcccttc atgccatagg ctcgattttt cctgttctct tggcaatccc
42051 tctggttcag ccaggacagt agcctcctct ctgacaccaa gatggaccat
42101 gctcttcccc agctccaaat gtgtgctcct tgatggaata gacacagtgg
42151 acaagaggac cctcaggtgg ctttgagtat ttgcctcaag cccatcatcc
42201 ctgaaggcag atgtgcttga tcttaacaga gcccaggaag tctccctca
42251 gatacaattt tggaaaaagg acaatgaaaa caaaagtca taactgtcta
42301 ggttctttgc attttgaaca aagaattgga caaaaagcac aaacaaagca
42351 acaaaagaaa agcacagatt tattgaaaca aagtacgcg acacagagtg
42401 ggaggggggct cgagcaagca gctcaagagc tttggttaca gaattttctg
42451 gggtttaaat accctctaga ggttttccat tggttacttg gtttacaccc
42501 tatgtaaatg aaatagtggc ccacgatcag tctgattgat tgcagaaagc
42551 aactaatcag aggctgaagt gaagatacaa agttacaccc tatgcaaatg
42601 tctgattgat tgcagaaagt gaccaatcag aggctgaagt gaacttacaa
42651 agttatactc ctctgcaaat gaagacttgg cctgtgacca gcctgactgg
42701 ttgcaggagg ggaccaatca gaggtacttt cagttttcat ctgcaatgca
42751 ggggaagttg gggggttgca aagggagtag cctctgatcc ttttgttatt
42801 tgggtgtgga gaggtgggct tttctttttg attcagttct aggaattcgg
42851 cgcgaatcag ccttaggttc cctgcctcca gaccctactc tcctgcctca
42901 atagccatgc ccagttagtg ttaactgtaa ctccctgctg gtctgcctcc
42951 tgctaggagg gactgaacat caaatcactc gcatcgaatt actcagcagg
43001 tgagttctgg ggatgataac cacacaattc tctctgcacg aaagatgggt
43051 ttgagagcct cagagtctgg gggaagctct gccagccatc cacttactgg
43101 cttactgttt gcctgaagta agcatgggaa tccacaggg tacaaggtcc
43151 cgcatacctc tctgggattt ccgatgccct ctttgcatgt gctctggtcc
43201 atcaagctcc catgccagat gcagtgcttg tagttgcagc agtgaccata
43251 gcagtggcaa cagttctaca gggtcacaga actttaggga agcctcctaa
43301 cacccctgct cttcgttagg ctgcagctgc tttcctgtcc atgatttaag
43351 catccttaga tcccagctgt ccaggaagct ctccccacgc acctcagcct
```

```
43401  aagtccagcc tcccactgag ctcccatggc atgactgtcc aggccccagc
43451  gcccttgtgc cctaaccggg gctgttccat gttgatatgt ggtctcctca
43501  ggcatggtgt acactactag agaggagggg ccaagtcttc catccttctg
43551  accctcttca aagcctggaa caaaattaga tattgagagt tgttcattaa
43601  gtacctgagt gaataatgaa taattgatta aagccagaga atcgggtatc
43651  acagtaagga gtccctgggt cctccgaact ttccagaata aaattccaaa
43701  atgagaacac caagaggttc cctggcttga gagccaaaat ggcggcacag
43751  acctatatct caggcacact ttgtggtaaa aacaagaagc cagacacact
43801  ctttctagac acacgtcaca cccagaatga cttagctttt agtctgtgga
43851  ggaaaagggg tggaaagtgg agacctggaa ccagatgaga agtcaacggg
43901  agcagtaagt tcagtgtgtg cctcctgtcc cagcacctgg gtcaacatgg
43951  gcaagacctg atggggtggt ggagatgctg acctttgctg ctgcctcttg
44001  ggcctgtaag agcaaataca atttaaaaaa aatttttttt ttaatttttt
44051  tttgagacag ggtctctctc tgtcactcag gctggagtgc agtggtgcga
44101  tcttggctca ctgcagcatt cacctcctgg gctcaaatga tcctcccacc
44151  tcagcctcct gagtaactga gactacgtgg agtagccacc ccactcggct
44201  cattttaat ttttgtaga gacatggttt tgccatgttg cccaggctgg
44251  tctcagactc ttggcctcaa tgaatcctcc tgccctggcc tcccaaagtg
44301  tggggataac aggcatgagc cactgcgcct agtctgcaaa ttcacattga
44351  aagaagaggc ctgtttgata gatcagtagg gtgactataa ttaacattaa
44401  tctaatatgc atttcaaaaa agctacaaga gaataatttg aatgttccgc
44451  tgcataaaga aaggataagt gtttaaggtg atggatattc cagttgccgt
44501  gatttgatta tattaatgtt accaaattat tacatatact tcaaaagtat
44551  atacatctat tatgtatcaa ctaaaaaaat aagagtttta attctccttg
44601  tggaaaataa gggaagagac ttcacctccc tcctttttct tagagatttt
44651  actttaggaa acttcaactt ttaagttctt tcctctgtct ctttgagatg
44701  tatgtaaatc ttttaaaaag ctaaataagg gccaggtgag ggggctcacg
44751  cttgttatcc ccagcgcttt tggaggctga ggtaggagga ctgtttgagg
44801  ccaggagttc aaagttacag tgagccatga ttgcatcact gcactccagc
44851  tgggcagcaa caggggccct gtgctttaaa ataataataa ataataaatt
44901  taagaagcta aataagcctc ttggcagctt taggacttag aaatatcttt
44951  ttcaaggacc aaggagccaa cctttgaaa cgtagtcatc aagagtttca
45001  atgggagggt aggagcctga cctggcaggt gcctcgctct aagttgcaaa
45051  actacctcct gtcctaaagc tatgagaggt ttgttttcc tttgaataaa
45101  gccaattagc taacatagat ggtgacatca gttaccaggt gaatctgtgg
45151  taaactctgt gcaacaaatg gggctgtcaa gtcctcttac ttgaggactg
45201  actagctatt gtctatgtgg agaacctgtc tggaataggt cacctctgca
45251  tgactctata aaagggtgag gtctcttttct gtctttgtag tctcttaggg
45301  gattgtgtgg gatgtgcatt acatttagt tgagtgctta ttcactaatg
45351  aaacagtttt ctttctccac tcccttgtg gagagatttc ctggggttggc
45401  agaggttgac ttttaataat attttctcca caggcccatc gtcccctgac
45451  tctgtgagct ttcagccaca cccaggatca gtcagatcaa ctgctcaact
45501  caaaggcatc ctagtgagca agggaaaact caaggtggtt tttggagggt
45551  gcttagttag gaaatgatga acacagttca acatgacttg cggccctccc
45601  catgggcaag agtatgaaca cctgtgactg ttcctgaact cactaaggaa
45651  agtcttttac agtgtgtgaa gggtgacctg gagtttcctt cccacatggc
45701  tcataagagc agcagctcag gaaaaacaaa acaagtattt atttatttat
45751  ttatttattt atttatttat ttatttattt ttagagacgg gttctcactc
45801  tgtcacccag gctggagtgc agtggcacaa tcatggctca ctgcagcctc
45851  aacttcgtgg gcaccagtga tcttcccatg tcagccttct gactggctgg
45901  gactacaggc atgcccccca tgtctggtta ttttttaaaa atttttatta
45951  gaaggccagg cgtggtggct cccgcatgta atcccagcac tttgggaggc
46001  caaggtggga ggatcacctg aggttgggag tttgagacca gcctgaccaa
46051  catggagaca cctcgtctct actaaagaaa aaaaaatat tagctgggca
46101  tggtggcgca tgcctgtaat cctagctact cgggaggctg aggtaggaga
46151  attgtttgaa cctgggaggt ggaggttgtg gtgagccgag atagtgccat
46201  tgcactctag cctgggcaac aagaacagaa ctccatctta gaaaaaaaat
46251  gttttatta gagacaagtt cttgcttttt gcccaggctg cttttgaact
```

FIG. 7 CONT'D

```
46301 cctgggctca agtgatcctc ctgccttggc ctcccaaagt gctgggatta
46351 cagggggtgag ccaccatgcc tggccacaaa acaatttag aaaagaaaaa
46401 agccttttat tttcacttaa ttgtcttgat ttccactcct ctgagacatt
46451 caccccagg aaacttggct gtgtagctat agatgataag tatttttaaa
46501 ttctccttga gaaatggcat tattctgcct tagatctcga actagaacct
46551 gacaatgagt cctcctgctt gccctgatc tggggcacac tgatattttt
46601 gcaggttcct tcaagcatga aattgcaaac ctaaacaaac tggttctcat
46651 aaaagcactt ccaatccttc aaataaaagg aggcagccta attataaata
46701 atctctggat tagaaacatc acacaccaca tctcttgcaa ttttatttt
46751 acctcgtctt tgaattccat gaacttcaat ttcatgtggt gttaagtgct
46801 ggcttaacct ggagagaaaa tataaaggat ataagaaat gtatataaag
46851 atttctcaga gttataaaaa tacttctgtg agagaattgc tacaaaaagg
46901 gagatgcaag accacccttt gtccaaactg gcattgtcta aatgcagttg
46951 agtgtcttgc cttagagtct gggcttgaag tcagtcagaa ctgactagaa
47001 caccagccct acccctcacc aatagggtac ccttgggcca attatttaac
47051 ccttctaagc cgtaactacc tcatccgcag aatggaaatg atgctaggaa
47101 gtacctgaca aggttcttgt gagaattaag tgagatcctg tgttcatcta
47151 gtcaacttgt atttcttat ttttaattgt attatacatt tttagagatg
47201 ggggtcttgc tctgttgtcc tggttggagt gcagtggtgt gatcacagtt
47251 cactgtattc tcaaactctt gggcccaagg gatcctctgg cctcagcctc
47301 ctgagtagct gggacaacag gtatgggcca ccatgcctgg ctaattaaga
47351 tttttaaaaa atagaaatgg gggtctcacc atcttgccca ggttggtctc
47401 cacctcctgg gctcaagtga tcctcctgca tcggcctccc aaagtgctag
47451 gattacaggc atgagccact gtgccaggcc ttgactcgtg tttcttgagc
47501 aaatcactga gctatgttta aaagatacac agatgaagga catataaacc
47551 cagtccctgc ccttaactta cagccgagct ttcaataagg gagagctatt
47601 aatattaagt cccactgatg gatgttaaaa tgtaaatgaa gcatagagtt
47651 cttagggcct aggctcttct tgatgttccc ttccaccatc cttggaactc
47701 tccagaacga gacttgtttt gggggaagga gggtgccttg gctgatggaa
47751 agtgcggggg tgggggccga aggaagtgca gggcctaaga ctgttgttct
47801 taagcattct ggaggctgct ggacatttag ctcccagcct cctctctacc
47851 acaatgaaca cttctatccc aggacttctc ctctccccct ccttagacca
47901 aagctcttgc agtctgagta ctggaaagcc cagcatgagc ctctccacgc
47951 acttcgaatg caccctcctc cagcaaaggc tggtaagttg aaaagacagg
48001 aaggatttca gaagactgga aattgaatcc cacactcagc tcctctttga
48051 aactctacaa tgagtgcttc attccttgga cttcagcttt tcaaagaaaa
48101 catccctaga agaaggacag cagggatagt catttacctt ttaatgagaa
48151 tgaattatcc agccctttc aggacagcgt ttgtgaggca gcaaagctaa
48201 atgttgagaa gggcctgaaa gaatgatgga ctgacgctgc caaaaagaga
48251 aagggcggga ccttcacagc tttgcctaag gccattatga atttggacca
48301 aataggtatt atcatccaca caggcaggac ctcctgggta gggggctgcc
48351 accttttcca ggcacttgga agggtggcct ccagctgtgg agccacagaa
48401 ctaaatatta tagctggccc aggagcaccc gtttaggcta gggaaggaat
48451 aataatccgg cttctccttc ctctgaccct gagatttcgg ccaagtctcc
48501 attagagatt ggcctcctag agtgtaaaac agggtggaca agtttggaga
48551 atggatctgg gatggggtgg ggaatggcaa atggaaaaaa ggcagcacaa
48601 actctttatt gtcattcaga gaatgctgag gtccaaggca caaccagcca
48651 gagggttgct tcagcctttc actggaaaag ccacatttc ctcagttgta
48701 tcctcacttc gagtgaggct ctccaaatg cagaaggaca gcatcatgac
48751 ccaggccgag aaagtatgat tgcaaaattc catgggccta accctagtgg
48801 gggagggaat ccattctttt aagccagggt ttaaaactct tcaagcaagt
48851 catctgcaaa ggtaccgctt ctaccatttt aaagatagga ttatgttccc
48901 taggacaact ggatgagccc taggaaccaa gaaccctgtg cagctggggc
48951 agaagcctga gggttccttt gttcccccac agctgtaggt cacaaggttc
49001 ttacacaagc tttggggtgg ccccacccca cacccttcct tcccctcagt
49051 cagtgatgac tcaagaggtt ttgggaagga gctcagggaa cactcaagca
49101 gcaggctcag cttacggcac ttctgatgca ttttctagat aacattagtt
49151 gctggttcca gacaggactc agaagtatgg acattcactc cccaggcttg
```

FIG. 7 CONT'D

```
49201 gtcatcagtg ccctgtgagt tcaggaatac actacctaaa ggagatcttt
49251 aggaaggaga aggagaaaag aggagaagag ggaaggaagg aaggcaggaa
49301 ggaaggaagg gagggaggga gggagggagg gaaagagaaa gagggaagga
49351 gagagtgagg aaggaaggaa ggagagagaa agaagaaaga aagaaataga
49401 gaaagcaaga aaaggaaaga aaaagagaaa gaaagaaaga gagaatggaa
49451 ggaagggagg aaagaaggaa gggaggaagg aaggaaggga gggagggagg
49501 gagctggccg gacgtggtgg ctcatgtctg caatcccagc actttgggag
49551 gccgaggcag gtggatcacc tgcagtcagg aattcaagac cagcctggtc
49601 tacatggcga aaccctgtgt ctactaaaaa aataaaatta gctggacgtg
49651 gtggcagatg cctataattc cacttacttg ggaagctgag gccagagaat
49701 ggcctgaacc cgggaggcgg aggttgtggt gagccaagct cgcgctactg
49751 cactccatcc tgggcgacag ggcgagactt catctcaaaa aaaaaaaaaa
49801 agaaaagaaa agaaagaaga gagaagagg aaaaagaaga aagaaagaaa
49851 aagaaaggaa gaaaagaga gtcattgaga cttgtggctt aatgttgtga
49901 atgtatatgt atgtttaact gtatatataa ccgtatgtat atgtatgtct
49951 caccagagag agaaagggat taaaaaaaaa aaaaagccaa aacctacaaa
50001 ggcaaagcag aagaaagagt accagactgg agatagcaat ataattacag
50051 aaaatgggaa gtgaccgcac agaccagaga aatcagaaac ctacatctgc
50101 cggggttgg ggtgtgtgtg tgtgtgtagc ctcaaggatt tactccgtgc
50151 cagccactga tctaagggtt gaaggtatat tcactttcgc gatcccccaa
50201 aaatgctagc aggatttgta ccctaatatt ggagactagg cacagaaagg
50251 tttaatttgc cccaggttac acagcagaat ctgaacctct ccgaggttcg
50301 gctctagaga ccacgcttga cacagcctca cagtcatgag taagcccttta
50351 gggaccaaac cccaggagac ctcaggctgg cagatcagga gcaccgaagt
50401 gggcctggaa acaggactgg gggaaagtct ggaggaaaag agaccctcgg
50451 aatccttccc cattttactt aggcaggcag ctgccctctg ctcccgggca
50501 gaaggctgtg ggtttcttta ggaggctttc cccagttgag gatggggtga
50551 gacacctatt aaaacaagag aatttaggcc ggacgtggtg gctcatgcct
50601 gtaatcccag cactttggga ggctgaggcg ggagaatcat ttgagcccag
50651 gagtttgtga ccagtctggc aacatagga gaccctgtct ctaaaaaaaa
50701 aataaaatta gctgagtgtg gtggcgggca cctgtggtcc cagctacttg
50751 gggctgggc ttaggtaggg aggatcactt gagcctggga ggttgaggct
50801 gcagtgagcc gagatcacgc cactgcactc cagcctaggt gacagagcca
50851 gatactgtct aaaaaaaaaa aagaaagaaa acaagagaat tcagtgaaaa
50901 tctgaattca gctcccatgt gttggcagtg aggcccacac accccaggcg
50951 ggggctggga gctcctctcc aggagtgctg attggctggg gagaagactg
51001 acggcactag catccgaagg tccctgctgg aattgctggt tcaccaactg
51051 acgagtcctg gccacataca cggggctcac acaaccttct gtcagctttt
51101 tgttaccttc ccctttttc ctacactttt attatggaaa aatgtaaaca
51151 tacagaaaaa caacacaaag agtacaatgt gcccactccc tctgttctgc
51201 agttgttagc accttaccat atttatcttt agatatgtgt gtgttgtgta
51251 tgttgttttt cttttccttt ttttttttt tttgagacac agtctcactc
51301 tgttgcccag gctggagagc agtggcacaa tctcgagtca ccacaacctg
51351 cacctcctgg gttcaagtga ttctcctgcc tcagcctcct gagtagctgg
51401 gattacaggc atgcactact aggcccggct gattttgta ttttggtag
51451 agatggggtt ttgccatgtt ggccaggcta gtctcgaact cccaacctca
51501 ggtgatccac ctgccttggt ctctcaaagt gctgggatta taggcatgag
51551 ccaccacgcg cagctgtgta tattgttttt ctgaaccatt tgaaaatgag
51601 ctgcagccat aatattttcc catacatatt tcagtatcta tcttcacaga
51651 ataaggacat tatcacacat aactaaatcc atgacacacc caagaaaatt
51701 taacacaatt ttctaatgtt gtctcatgtt gaatccgtat tctagcctcc
51751 tgcattggcc ctagaatgtc ttttccatgt gcacacattg catttggctc
51801 ttatgtctct ttattctcct tactagaata ttcccaacct cttgttttcc
51851 ccacaatgct gactttttga gtaggccagg ccatttagtg gaaggagcat
51901 ctcatatctg atttgtctga ttgtttcctt gtaccgtcat ttaacttgta
51951 cctctatctc ttgtaaatcc cataaactgg aagtgagatc taaagtcttg
52001 actagattca gatcagacac ctttgacaag acacagagct caagttttg
52051 tttttttttt gttttttttt gagatggagt ctccctctgt cacctaggct
```

FIG. 7 CONT'D

```
52101 ggagtgcagt ggtgctatct cagctcactg caagctccgc ctcccgggtt
52151 caagcaattc ttctgcctca gcctcccaag tagctgggac tacaggtgcg
52201 tgccaccacg cctggttaat ttttgtatt tttagtagag gcggggtttc
52251 accgtgttag ccaggatggt ctcgatctcc tgaccttgtg atctgcctgc
52301 ctcagcctcc caaagtgctg ggattacagg catgagccac tgcgcccggc
52351 tgacacagag ctgaagttct atccttcatg tcgcattgta tctggagaca
52401 gcgtctgcat aggtcactag cagtgaagcg aagtttgatc acttggtgga
52451 ggcagtgact gctggatctt tccactgtaa aggcacacgt ttcccttcgc
52501 caatgacctt cgggtaacac acccgggcac agtgtgaata tcctgcgcaa
52551 tgccttactc agatatggac aataaaggat gacaggaaac ggagaaaaag
52601 ctttcaacat gaaagagtga gacagaaaca aacaggaaaa agctttcaac
52651 atgaaagagg gagacagaaa caaacaggaa aaagccgact cagaggaaag
52701 agagaccatc gcaggaagca aaagaaaact tccctaaac aataaatagc
52751 cttaaaagtg agaatatata ttacattcat aattgacaag attgctatga
52801 aaaaaatatt tatttattta ttttgagaca aggtcttgct ctgtcaccca
52851 ggggagtgca gtggcatgat catggctcac tgcagcctca agtgcctggg
52901 ctcaagcaat cctcctgcct cggcctccca agtagctgga actacaggtg
52951 tgcatcacca cacccagcta attaaaaaac aattttttg tagagatggg
53001 ctctcgctgt gttgcccagg ttggtcttga attcctggcc tcaagtgatt
53051 ctcccacctc agtctctcaa agtgctggaa ttacaggtat gagccactgc
53101 acctggccaa aaaaaaattt caaaaacaag atagtgctct tgggctccac
53151 actgaaaaat ccactgcaaa attggaaggt aaagtacaaa caaaaatttc
53201 ttataaagta gaacaaaaag atgaaaaata gaaactgagg ccaggtgcag
53251 tggctcacac ctgtaatccc agcatttggg gaggccaagg caagcggatc
53301 atgaggtcag gagttcaaga ccagcctggc caacatggtg aaacctcatc
53351 tctactaaaa atacaaaaat tagctgggcg tggtggcacg agcctgtaat
53401 cccaccctact tgggaggctg aggcatgaga attgcttgaa actggaaggc
53451 agaggttgcg gtgagccgag atcgtgccac tgcactctag cctgggtgaa
53501 agagcaaaac accatctaaa gaaaaaaaaa aaaaagaaa agaaagaaaa
53551 atagaaactg aaaacacagg aaaactaaac aattagtcca aaagtttagc
53601 atcagaatca tggcagttcc agaaagacaa aagagaaaaa gtagagggcg
53651 tgaattatca gagaaataaa gcaagaacag gccaggtgct gtggctcatg
53701 cctgtaattc cagcactttg ggaagctggc ggggagcgga tcacttgatc
53751 ctaggagttt gagactagcc tgggcaacat agtgagaccc catttctacc
53801 aaaaataaaa aagcaaaatt agctgggcat ggtggcttgt gcttgtagtc
53851 ccagcaattc aggaggctag gaggtggagg ctgcagtgag ccagccatgt
53901 tcatgccact gccctccagc ctgggcgaca gagtgagact ctgtctcaca
53951 aaaaaaaaaa aaaaaaaaaa aaaagaggaa gaaataaaga aagaatgaaa
54001 ctatagtata tgagatgatg ggtatgttaa tttgcgtgac tctagtaatc
54051 agttcactat atacatcaag ataagtatat caaaatatta gtttgtgtac
54101 cttgaatata tgatatattt aaatataaaa ttacatacaa tttaaaaaat
54151 acctttaaa aaacaaacac aaaagcacaa tattgtgaac tttctgaaca
54201 tcataaaaga ggaaaacagt tcacatacaa aagatcagga atcagaatgg
54251 cattaaactt tttaacagca acactaaaat ctaaaggata atggagccag
54301 ggccgggcgc agtggctcat gcctgtaatt ccagcacttt gggaggccga
54351 ggtaggtgga tcacctgagg tcaggagttg gagactagcc tggccaacat
54401 ggtaaaaccc cattcttacc caaaatacaa aaatcagccg ggtgtggtgg
54451 cacatgcttg taatcccagc tacttgggag gctgaggcag gagaatcggc
54501 ttgaacccga gaggcagagg tcgcagtgag ctgagattgc accattgcac
54551 tccagcctgg gcaacagagc aagactccgc ctcaaaaaag aaaaaaaaaa
54601 aaaagaggat aatggagcca ggtgccatgg ctcacgcctg taatcacagc
54651 actttgggag gctgaggcag aaggaacact cgaggccagg agtttgagac
54701 caacttgggc aacaaagcga gaccttgtct ctacaaaaaa taaaataatt
54751 agccaggcct ggtgtcatgc acctacgtag tcccagctac ttgggaggct
54801 gaggcaggag gatggcttga gctcaggagt tgaggctgc agtgaactat
54851 gatggtgcca ctgcactcca aactgggtga cagagtgaga ccctatctct
54901 aaaacaataa ataaatgggg ccgagtgcag tggctcacgc ctgtaatccc
54951 agcactttgg gaggccaagg cgggcggatc acgaggtcag gagatcgaga
```

FIG. 7 CONT'D

```
55001 ccatcctggc taacacagtg aaacccgtc cctactaaaa atacaaaaaa
55051 gtagccgggc gtggtggcag gtgcctgtag tcccagctac tctggaggct
55101 gaggcaggag aatggcgtga acctgggagg cggagcttgc agtgagccga
55151 gatcgcacca ctgcactcca gcctgggcga cagagtgaga ctctgtctca
55201 aaaaataaaa aataaaaaat aaaaataaat aaataaataa ataaataaat
55251 aaatgataat ggagcaaagc cttctaattt ccgagggcaa tttgaacaac
55301 aaaattgtcc agtgacccat aggataaaat aaatgagtca gtgctaataa
55351 aaataaataa ttgaatgact aaataaatgg agaagaaata gctctaccct
55401 acaagagaat tccaattaat aaatgtaaaa gaatgagga aaaagaaaa
55451 tcactattag aacactacag taataattgt tgcaggcaag attcatcaat
55501 gaatgctata attagttggt aaagtttga ggattaacag gatatttaca
55551 tagtctcaaa gtatgtccac taatatattt attatctgca aaaggaaaaa
55601 actttatgat ggagaaacta gcagaaacca ctttcaccac atgatcaagg
55651 ttagcatcac cagtaataag tctgatcaac atcaagcacc caacacgatg
55701 tactgagaag ggcacgttac ctccatggta ttcttgcccc aaacccataa
55751 ctgtctaatc atgaggaaaa catcaaacaa atccaaattg agggacattc
55801 caaaaaaata actgaccagt cttttcaaa actgtcaaag tcatgaaaga
55851 caaagaaaga ctgcctagga caggaagaga ctgagaagac ttagcaacca
55901 aagcaaagtg gaatctcaga ttggatcatg gaaaaatcaa acgacattgg
55951 aaacattggt tatatctgaa gtctgtagtt tagtaagtag tagcgtacca
56001 aagttatttt cttagttttg atcattgtac tatggctatg tgagctgcat
56051 aaagacatta catagaactc tgcagtgtct ttgcagcttt tctgtaagtc
56101 caaaattatt taaaaataga aagtaaaaat tcagaagagg aattatttcc
56151 aacctagaat tttataccta aactataaat caattgtgag catagcataa
56201 tgacatttct cagacatgca agggctcatt cactttctgt taggaagcga
56251 ctatagtttt gctcccttaa aagaatgaac caagatgcag acatggcatc
56301 taggcaacgt ggaattcaac actagaggga agcaaaggta tttccagaac
56351 tgtggctaag cagaggcttc cagaacaacc agtatagatg ggagcaaggg
56401 gactaattgt tcctagagga aggatgttgc aaaccaacca gctaaccaac
56451 caatcaccac caacagttta cctatctatt tgattatatc ggggaagttt
56501 tccgttttgg cagagtgtgg gattgaatta ttgataagta tgcagaaaac
56551 taagcaaaca gaaaaaaaaa aaagacaatg atcagctctt gggaaaacaa
56601 aatgttgccc tgaaagaaa tgtaatcata gtatcctaaa tgactcactt
56651 gtggataatt tttccatagt cacgataatg taaatactaa atactcattt
56701 aactaaatat ttatattggg aggagggaag aagggaaata tgtgtgtgag
56751 tggagtatag ggataagaat taaattcttg ttttcaaagg tgagaagcaa
56801 gaaaatctct gtccaatggg ctcccagccc caaggcaagc tgcacatttt
56851 aggtatcatc tgggtgggaa tagtgagggt ggtgtggcag atgtgaacac
56901 acaggggaat cctctcttct gctgtcctag gcaaactggt ggctagtgga
56951 aggaagccaa ggctgagtgg gattagggct aggaagatgg gccaggctgt
57001 gctggctcgt gatgcaatga cctcaggttc tatttcagca gggttcagca
57051 tctaaggaga tgccatctag ggtggagtgc agccacaagt caaagcagct
57101 gatagctgtc acgaggtggc tgtggcctgg tttgggcctt gttttcaagg
57151 taggttctgt gaaacactac ttctgaagga tgtaaagaac tgacctgaaa
57201 agagggttcc ttggtccaac atgcttgaga aatgctggat tcaatgacac
57251 taaacaagtt tctccaatgc aggacatctc aaaacccttc atatgattat
57301 gggaatatcc aatctctaag gcatggcatg tgggggagat ggtgacagag
57351 tgtttgatca tgaccatgga acccttccta tgcagaactt aacactggac
57401 tagaaactca ctgacaaccc tttccagagt aggggtcggc gtcagtcagg
57451 gccggcacta acaggaaaag cacctggttc cttgtatctt cacatcttta
57501 ccatcactgc caacccttt ccactggcta gggctaatta gggtttggg
57551 gccaacaggc aaatgaactg aggtttgaga caggctctgc tctcatgaaa
57601 aactgaagtg ttaacaagac agaaatgtag gcagaggccc agttataagg
57651 tacagaggca cccagcaggg gtgggactca gtggccccca gacctgtagc
57701 atgctgacag gcccacgcaa agccaagatc aaacctacag cagcccttct
57751 ccatcagccc agcaccctga gtcgcattcc ttggtcaggc tctggaaatg
57801 gtagaggcag ctgctgtggg aaggtgaacc ccggggggttc tggcccagct
57851 tgtttggggc aaatgcagga gctgacaact tacaatcaca gcctgtcccc
```

FIG. 7 CONT'D

```
57901 actcacctgc tacagaggac tcagtcattt catttccctg atttctccag
57951 gtctctagtg ggggttccct ggtgccgaca ccattccatc caggagctga
58001 tgaaaacccc tcttctctga agcacaggca gaatgtatcc ttagaaagga
58051 agccagggg ccgggtatgg tggctcacgc ctgtaatccc agcactttgg
58101 gaggctgaga tgggtggatc acctgagatc gggagtccaa gaccagcctg
58151 gccaacatgg tgaaacccca tctctactaa aaatacaaaa attagccagg
58201 catcatggcg tgcacctata atcccagcta ctcgggaggc tgaggcagga
58251 gaatcacttg aacccgggag gtggggattg cagtgagccg aggttgtgcc
58301 actgtactcc agcctgggtg acacagggag attccatctc aaaaagaga
58351 gaaagaaaga aagaaagaaa gaaaacacag ggttgctaag gccaaggcat
58401 cacacactta acaccaccaa gtcattccag agtgaaagga acgcaaatcc
58451 agtctcaggc tgtctgattg acgaagcttc tggatgcaca gcttttacat
58501 ttttatattt tattctctgt gatgtgccca gctcaggagc cgcaggtttc
58551 ggccagttgt tctgctctag tcctgagcgc cctggcatgt tttacagttc
58601 tgagactgtc ctatattcag ggcctgtacc atggacagat gcaaagccac
58651 taaatgtgtg agctggaata gacaagaaca gttatattga gtgtttacta
58701 catgctcgtc ctcacaacgt tacgtgctaa gcactaggag tcgcagtttt
58751 tggggtgcag aggctgagga tgagggcagt tacatatctt gtcaagtctc
58801 cccctggcaa ggggcagttg taactcagca cttcctggtg gcacagcctg
58851 ggctctgggc tccccccca acgcttcgca ggtggcctgg ctgccactgt
58901 tccccatggc actgggcagg ccgctcacct tttgttgttg ccaggctctt
58951 cgataatccc tgtccatggg gttcatgaga ttatagcgag gatcagataa
59001 tgcagtgagc agaaaagtgc tttggagtgg agtgaataca cacatggggt
59051 gccaatcaca gccagtcctt ttcctagcta cccaacaatt tggcatccca
59101 aagggatcac cctctctagc gcgtgtttat gagctgacta gaaaaaggca
59151 cgtagacgca agaagacaga agtgtgattt tgaaagtggg tacccctta
59201 cccagagctg gaaggcatga aggaggtaag ggtggagacc caccgtctag
59251 aggctttgaa ctgaaaccct ggaagagtga actctctcag acctcatggc
59301 tgcccccacc ccctcccaac ccttccccta aaggctttag acactaaaaa
59351 taccccagcc acctgctgcc ctgggaggca ataaatcatt ggccatctag
59401 caccagaatc cgggccaaca tggcagcgga cacagaccca agggatcagt
59451 tcccttcctc ccacccaggc caccatcaag agcctgcctg ctgctggggg
59501 tgggggggg gggcagggg ggtgggggg ggcggggcag ggggcgagg
59551 gagtgtgttc agaggacaca ggacctgctt ggaggcttct ggggccagaa
59601 gtgctaagtg ggtgtggggt aagcggaagg gagtgagtca ctggaggggg
59651 tcctggggaa agggcggtgg ccctgtgcc gcgacagcca cctgctttat
59701 tatatagaat aaggtcatct catcaaaacc acagctgagc cgcccaacga
59751 ctgtcctact actccagggc caccagatgt cagtgttaaa gggatcatgg
59801 atattggtga tcagatgtca ggacagggac tgaatgtatg gagactgttc
59851 aaaccagggg cgctcagggg caaacctgtg aaatcggttt cctgcttcca
59901 gttcttagca attagatcct accccaggg actgaaatca gtcccactcc
59951 caaaaggtaa ccacaaaatg ccaaagatct gttcatcttc actctcagca
60001 caataccatg tatcataaat gagaggcaaa ggcagaattt ctaatttact
60051 tattattaaa atgcatcatc aacaaacaca ccatagtggg gaacacgaag
60101 cgatgtgttg cagtgtagtg ttgctcaaat gtgaaaaagc agcgacccct
60151 gagagtctcc tttgttttgt tacctctctc tctagaaaaa gcactgcatt
60201 gtaagtgact tggtccaacc agtgaaaaat acaaacagga ccattcatag
60251 acaaaaaagt gaagaataaa attcagtggt cactcaagta taataaatag
60301 acccaaatga tcagaaatgt gtttatgttg attgttttag agcattaaaa
60351 aatccaaaaa tttgggaggc taaggtgggt ggattgcttg agcctaggag
60401 tttgagacca gcttacacaa catagtgaga ccccatctct acataaaatt
60451 aaaaaattag ccaggtatgg tgcatatgt ctcaactact caggagcctg
60501 tggtgggagg atcccttgag cctgggattg aggctgcagt gagctgtgat
60551 tgcaacactg cccttcagcc tgggcaacat agtgagatcc tgtctcaaaa
60601 aaaatgctat gtggccttgg ggaggtaatc tgacccatgt gcctcagttt
60651 ctatgtctat aaactggacc tctccaaagc ccctttaagt aatgtaagat
60701 tctaggattc taagtgtgac tttgagaggt tcctgtggag ttgggaaggt
60751 gaatgtacaa aaattccaac ggaatgccac ccagggccac ttcagcaaca
```

FIG. 7 CONT'D

```
60801 tagacaaaga ctgagaattc agaatgcctc cctcccaact cctcagggac
60851 ccagggaagg cttctggaag acaagggatt acaccccctat gacctaatgc
60901 tgtagcatga tcaaaatact tgatctcttt ttaagagctg ggaggtggcc
60951 agtcagatat tttaagatgt caacttgatc tgtatcatta tcagcatcta
61001 aggaaacatt ttgtttccaa aaacaaatga tcactgctat ctataaacct
61051 ctgtaagcac atgaaattct caagaatggg gccttttccg taatactctt
61101 cacagctggt tttgtgtgta cacgtagaac tgctgcttcc tgaacgataa
61151 gtttaggcca aggaagaaag aggggaagaa ggaaggggga gaaagtcttt
61201 cttcaggagt ctccccaaaa tgttaatata tgcacagaaa aaagtttgaa
61251 aaatagaaac aatggcaagg agcagtggct cacacctgtc atcccagcac
61301 tttgggaggc ctattgcttg acccagggg tttgagacca gcttgggcaa
61351 catgatgaag ccctgtctat ataaaaaat acaaaaatta gccgggcttg
61401 atggtgcttg cctgtcgtcc caggtacttg ggaggctgag gtgggaggt
61451 cacttgagcc caggaggttg aggtggcagt gagccgatac catgccactg
61501 cactccagcc tgggtgacag agtgagaccc tgtctcaaaa aaaaaaaaaa
61551 aaagaaagaa aagaaaaaaa agaaactaac tttgtaacag gtaactgtgg
61601 ttctgtctga tgatactgga ggtaatcatt attatttttt gcttatctga
61651 attttcatt tttcagcaaa gaacatgtca atttgcgtaa taatttttt
61701 taatgcaaat acatgcagga agggtaatac atcaaatcat tatccgttac
61751 taactccttg atgttagtga atgggtgtga tttgtttcct acactggtaa
61801 gaagtggatt ttgttaggtc tggggtctgc agatctcaag gtggcactta
61851 aggcagtaga aagggaagag agaaggtgga gaaccctcaa aagggaagtg
61901 ggtggagaag gttggctcac accttaggcc cgccagctgc tgcctgtaac
61951 cttgagggca tttatttatt tttatttaaa aaattattta tttttagttt
62001 ttgtagcaat ggggtcccac tgtgttgccc aggctggtct tgaacttcca
62051 gcctcatgtg atcctcctgc cttggcctcc caaagtgctg ggataacaag
62101 tgtgaaccac tgctcctgac cagagggcat taataacaa ttaaggataa
62151 taacagttaa cctttctca tgcaaggctt tgcccaatta ttctctttat
62201 aaataacttc tctttagagt caaactcaag tgttcataac aaacaagaaa
62251 aacagcacat ggattttaat aacttaaaa taatgaaaaa caaatgattc
62301 ttctccaaac tttttcattt tgatttccat caaaactttg agaaggtttt
62351 cttttacaat ttccgtattg gaatctatag actttttcttg aagctccagt
62401 gtaaatactt caggagttat agagctcgca taattaaata caagcaaaca
62451 tcatcattta aacacttta aataggttat gctgactttt gccccaatat
62501 tttctagaaa ggaagagttt gcaaggaaa tttacagtat aaacaacact
62551 ggggaggtat cttagtccat tttgtgctgc tgtaacagaa aatctgggtc
62601 tggataattt ataaaacaca gatttatctg gctcatggtt ctcaaggctg
62651 gaagttcaag attgagggac tgtgtctggt gagggagttc tgctgtgtca
62701 tctcatggca gaagggtgga aaggcaaaag ggcacaagca tgagagagag
62751 agagagagag agactgaaag agacagaa agagggagcc aaactcatcc
62801 ttttatcagg aagttgctct gctgtgataa ctaacccgct cagcattaat
62851 ggcattaatc cattcatgag agcacagccc tcatgaccta atcacctctt
62901 aaaggtccta cctctcaaca ctgttgcacc agggattaag tgtctgatac
62951 atctttttg ggagacacat tcaaaccaca gcaggaagga tggattcttt
63001 gcatgaatca ctccctacaa tataagctat tcaaaaccca ttgcgaatca
63051 ttttatatat tcatgaaagc atgccttcta tggctggctc cctggcaaca
63101 aatgtgatgg gcagaggata gaaggtacca gagtaacaga tctctaaatg
63151 tcgaaggcaa aatgtagact tttaaaataa actctaccag gtgcagtggc
63201 tcatgcctgt aattccagca ctttgggagg ccaaggcggg aagactgcca
63251 gaacccacaa gtttgagacc agcttgggca acattagacc ccatttctac
63301 caaaaaaaaa aaaaaaaaa aaaaaaaag ccaggtgtgg tggctgtgcc
63351 tgtggttcca gctacttggg aagctgaggt gggaggattg cttgagcctg
63401 gaagtcgaag ctgcaatgag ttgtgattgt gccactgcac tccagcctga
63451 ggtgacagag agagaccctg tctcaaaaga aaaaaaaaag aaggaaaata
63501 aattccaatt gtttatcaag tagttggaga tattgaggct tgaagaggga
63551 agcaatattg aggcagtgcc ttgttcattg aatctaagag gccgtcaagc
63601 gtaagatgta ctgtactttg gacagaaaaa actggcaggg tgtggtggct
63651 cacacctgta atcccacact ttgggaggct gaggcaggca gattgcttgc
```

FIG. 7 CONT'D

```
63701 ccaggagttc aagaccagcc tgggcaacat ggcaaaaccc tgtctcatca
63751 aaacaaacaa acaaacaaag aaaaacccaa aatgacaaaa attagctggg
63801 cgtagtggtg catacctgtg gtcccagcaa ctctggaggc tgaggaggga
63851 ggatcacttg agtctgggag gcaaagattg cagtttaagc caagatcagg
63901 ccacggcact ccagtgagcc aagatcaagc cactgccctc aagcctgggc
63951 aacagagcga gaccctgtct caaaagaaaa aaaaaaaaaa aaagaaccac
64001 tgccaactaa attatgacat ataaactgca aaatgcatcc caattttaaa
64051 aatgttaaaa tgtgggggaa agtaccacct tggatcaatg aactacagca
64101 ttcccccagt ctgcttgctc ccacctcctt gtcagggtgt gacgggattc
64151 tactcacagt gcctgtggct ccttaactgc tacacgggga caccaaccct
64201 cctcccagct cacttcactg tgaaggcatt tagacgtgtc cttacttggc
64251 agtagagtgg gtctgtactc caagttcctg tcagagtata atccccattt
64301 ctctcccatt tgatactcag caaaaactca atggagagaa atcatgcttg
64351 cagtactgcc ggcaggattg gcagcccatc cattttgctc tactctgttt
64401 acccttggat tgagccagat cagcagagag caaagccctg gaaccacgct
64451 gggtaatccc tcatgggaag gcctgcgcag acgctcctgc tggcgggctg
64501 ttggcccacg ccagggaggc tgttagaaac aggccgagtt gtcctgaatt
64551 tgctgtcaag gacacagcaa tgggtcttca tgaggaccac tggagacatt
64601 tttcacgtct tcataccaga aatttaaaaa aataaataaa attttaagaa
64651 atggaggata tgatcactac gcattacata catgcagcaa attttctcat
64701 gtatcccata aatgtgcaca aattaaataa atatgaaggt gttttcta
64751 atgcagttgt tataatcata aaaagttgtg catggatgat gtattagtcc
64801 actgtcacat tgctacaagt aactacccga gactgggtaa tttataagaa
64851 aagaggttta attggctcag ggttctacag gctgtatagg aggcatggct
64901 gggggaagcc tcaggaaact tacaatcatg gcggaaggca aggtgaagcc
64951 ggcacttcct acatgggcgg agcaagagga agagagcgcg aaagggacat
65001 cgctacacac tttacaacag atctcgtgag agctctatca tgggacagca
65051 ctaggggaat ggtgctaaac catgagaaac caccccatg atccagtcac
65101 ctcccaccag gcccctcttc caacactggg acctacaatt caacatggga
65151 tctgggtggg gacacagaac catattaggt gatgtaaaat tcacttcctt
65201 acaaaggttt ctgactatgg ttaaaacaca tcagcctgag tttggcccat
65251 ggggaagtaa agaataacta ctgataatga accaggaaat ctgactgaat
65301 aaattaccaa ataaaatgat attatgaaca aaaataaaac acaccttgag
65351 caacatagtg ataccttgtt tctattaaaa atttaaatta cctgggcgtg
65401 gtagcacatg cctatagtcc cagctgcttg agaggctgag gtgggaggag
65451 agcttgagcc tgagaggttg aggctgcagt gagccatgat cttgccgctg
65501 cactccagtg acagagtgaa accctgtctc aatataaata aaaaagtata
65551 acatatatac agaaagtac ataatttata aatgtacagc caaatatcac
65601 aaattataac taccccaaat gaaaaaata ggacattacc agaagcccct
65651 atgacttctc cccatcactg cacccatctt gtcccccaaa ggcaatttcc
65701 atccggattt cttgattttt catttttat ttttggtttt ttatacagaa
65751 aggtctcact atattgccca ggctggcctt gaactcctgg actcaagcga
65801 tcctccctcc tcaacctccc aaagtgctgg gattacaagt gtgagccatt
65851 gtgcctggcc atcctgattt ctaacaccat cgattagttt tatgttttta
65901 aactttacat caataggatc accgaacatg tattcttctg gtctggctcc
65951 ttttgctcct cattatgtct gcaaaatttc tccatgttgt tatgagtagc
66001 agaaggttgt tcatttttg agacaggatc ttgctctgtc gcccaggctg
66051 gagtgcagtg gggtaatcac ggctcactgc agccttgact tcccaggctc
66101 aggcaatcct ccccactcag cgtcctgagt agctgggacc agaggcgcca
66151 ccaaacctag ctatttttt ttttcattt gtggtgtgag ggtctcacta
66201 tgctgctcaa ggctagtctt gaactcctgg gctcaagtga tcctcccgcc
66251 ttggcctccc aaagtattgg gattacaggc atgagccatc atgcctagct
66301 ggttgttggt tttcattgct gtacagtaat ccatttacgt ataacttatt
66351 catttagatt gtttccaatt tgggattatt atgaataatg ctgccattct
66401 ggtgcatata ttaagcattt ctgtgaggta catacctagg agtcaaactg
66451 ccgggttaca ggatatagat gcttggctaa gctcttgggg gtgactacgg
66501 gatgaccaca gaatggacca cccccaaggg cagcactacc agtgaggcca
66551 ccactggggc tactcagacc acagacctgc tgctcccgcc atgactgcct
```

FIG. 7 CONT'D

```
66601 cttgataccc agggagttgg acacttggta tagtaatgcc aaactctcac
66651 atttccatga ccttacttgt ctgcacaaaa cagaaaagag ggagagagac
66701 agagagagag ggagggaaga agacaggaga gagagaggga gacagagaga
66751 gagagaaaca gtagaaaatg gcctctatat tttcaccctc caaatctctc
66801 aagtacttct gaaaggtaaa accaatttgg catctgggac cagggcctgc
66851 agcctctgca gggtaggaag ccaacctaga aggagagtgg aacacagact
66901 gagctatcag agctacagca tccgccacaa cataccaagg gcctggtcta
66951 tgtgctgggc aaggcagaga tcagatctgt gagctcaaga gtctagtaag
67001 aaaggcaagc actgaacaag ttaacgtaag tacctgctcc ccagccacca
67051 cagaactgct aattcatctc ccagacgagt gttttctgaa acgcaatgta
67101 atcacgagtc cctcttggtg ctgagggtaa gtgccaaatt ggtgctttcc
67151 ttctctcaat tctgtagaag gttagggcat acattttgca tatttatttc
67201 atgctcatct tatttctctc tcactctccc tgtgttccta tttcctgatt
67251 tacttttcat cataatgtat tatgtatttc tgcaaggcat ctccaatctt
67301 cctccttgaa aaaggacaaa tataaatcaa tcatctctct gcatggggcc
67351 ccagtgttta cccatttact caggaggagt cagctcactc accagctcct
67401 atttgggttc acaaacttta aatagtataa atataaaaac agaagctttc
67451 aattcatttc tggtttcaca ttggtaacca aaaaagactg gtgagaagat
67501 taaaagatga ggcaagaaca tttcctttgg aataaaaaat taatataaca
67551 ctgcagtatt ctaagataat tggtttact aatgtggaac aattaatgcc
67601 agccataaaa tgtataatta aacattttat tattacaaat tcaaatttgt
67651 tctcttttcc ctatatcacc atttaattga acaacaatac aacgaaaact
67701 ggtcgcctta aaaccaattt gaaacaggtt gttcaggagc aacaatacaa
67751 aaacaaagtg tagactggaa tgtattacat tttggccaaa caaaaagatt
67801 tgattcattc tggttcatga agttagataa tggtgtttat ggttttgaaa
67851 gttcactgaa acttcttcac tgaactggtt tctttctgat gcattttctt
67901 gagttctagc catgactgcc acagtagcag tcctgggatc agaacccaca
67951 caccgttaaa aaaaaacagg taaagccaac agtacagcca gttgctggtg
68001 ttgaggttgg ggcttctggt gagccactct gggaggaagg tcatccagca
68051 gccatacagc tcgcacacgc acagggtgat ctgcaggaaa tgcctgttgg
68101 agagaaagaa gcccgggatg aaccaccagc ttggcacagt ttggcatcag
68151 agtcatgaca tcttgtctgt aatggcggca tcaacagtct tcgctatgaa
68201 aaccgtccta agttgggcct cagatgttgg gtggtgctat tttgatgggg
68251 gcaagtcaat ctaattaatg aaggctcatt ctttccttag aggagcaaca
68301 ctgccctttc tagattattc tcagagttaa gtaaggaccc tcagggatcc
68351 tgacccattc ttggggaaat ttggtgagat cacacctgac ttaacacaga
68401 gaggcctgac tctgaatctc accatgagcc attataaaag gggagagtga
68451 gtaataaccc cttcctcaaa cagtgtagtg cagactaaat gagatatgag
68501 gataaagggc caagcgatgg gcaagtaaaa ggctcaataa tgcaaatatc
68551 acaaatgttt aaaataataa acacatgggc acacgtagta agtttgcaac
68601 cagcgtcatg gagtgaaaaa tacgtcaagg taccaaggaa aaatttaatt
68651 tttattgcca actatctctc taaaattggg tggggaagga agctttaaat
68701 aagacttctt cattacaaga tggtggaaaa tggaatgcag ctgtgcctac
68751 ttgaaattgt tttagggatt catctcagga tagcaatcta ttcaccccag
68801 gccactctgt ccctaaggaa agaaaaggaa ggaagggagg agagtttata
68851 gtctctgagt ctgataggat ggataatttt ttcatccttt tttttttgaga
68901 cagagtctcg ctctgtcacc taggctggag tgcagtggca cgaacgtggc
68951 tcactgcaac ctccacttcc caggttcaag caattctcct gcctcagcct
69001 cccgatagct gggacttaca ggcacccgcc accgtgcctg gctagctaat
69051 ttttgtattt tgagtagaga cggggtttca ccatgttggc caggctggtc
69101 ctgaacttct gatctcgtga tccacctgcc tcggcctccc aaagtgctgg
69151 gattataggc atgagccacc gcacctggtc tctctgcact ccgcctgccc
69201 catatccttc acaatctgct tctgagaaga tttcctattt atcttgcaag
69251 tctgactcca aattatataa gataatttac ttttgtcaa gtgggacagg
69301 agttttcttg aatgatttgg ggggaaaagg atggacgtat tatggtttta
69351 ttctccaaag tattggtggc aaatcatcca agagcgttag caccattctt
69401 gcctctacag agtctaggtt gttattaaaa taatatttct catattttg
69451 attctgaaaa gtctgaaatg atcctagtag caccatcacc cttatctcac
```

```
69501 ataaaataat tttcatttct cttctgcttt ttttttttgg agacagggtc
69551 tatgtcaccc aggttggagt gcagtggcgt gatcatggct tactgcagcc
69601 ttgacctcct aagcccaagt gatcctccca cctctgcctc ttaagtatct
69651 gggactacag gcgtgtgcca ccacgcctaa tttttaaatt ttttattcct
69701 tgtagagaca gggtctcatt gtattgccta ggctggtctc aaactcctgg
69751 gatcaggtga tcctcccgcc tcagcctccc aaagtgctgg gattacaggt
69801 gggagccacc gcgcccagcc tctattcttc cacctttat ctaacaaata
69851 tatgtggtca caacctactc caaaggtcac ctaagtgttg ggacatgtaa
69901 tgtctcccct ccttccagca ggacagaaga agggcaccta ccggtaatat
69951 ttttctttga ctatggcata aatgaggaac aatgccagag acccatccag
70001 ggcgacggtc agaatttcca cagacacaat ggttggatca aaataaaccc
70051 atcttgcatc agctttgcca tattctttcc ctaaagacaa aatccatgtt
70101 gttactcaaa tggcaacaat ttttatgaca gttcatggaa atgacctttc
70151 tttcctttaa ggtggagata aatgagtaa tcgccactct ctctgcattc
70201 ttcacgatgc cttagtggaa ggcaggagaa gccctgggac caaaatgcgt
70251 ttaccacctg acacaagcac tgagaacagc agcaggttta caggtgtcca
70301 atcattcagt ttccagcatg ctttcacata cacgccctcc tcagccccac
70351 cctcttcaac ataagtagca gaattttaaa agaattcaac atggtcagat
70401 tttgcaaaga caatctccag tcatgatctt ggtaaataca ttgtaattcc
70451 ttacttcaaa atttccatat aaattctgta agtataatgg agatgtggga
70501 aatttgttat gaaggacatg tttataaaaa acacgtttat ggccaggcac
70551 ggtggctcac acctgtaatc ccaacacttt gggaggccaa ggcgggcaga
70601 tcacgaggtc aggagatcga gaccatcctg gccaacatgg tgaaaccctg
70651 tctctactaa aaatacaaaa aattagccag gcatggtggc gggcacctgc
70701 agtcccagct gaggcaggag aatggcatga acccaggagg cggagcttgc
70751 agtgagccga gattgcgcca ctgcactcca gcctgggtga cagagcgaga
70801 ctccgtctca aaaaaaaaaa aacaaaaaaa caaacaacca aaaacttgtt
70851 tcttggccag gcacggtggc tcacgcctgt aatcccagca ctttgggagg
70901 ccaaggtggg cggatcactt gaagtcagga gtttgggacc agctcagcca
70951 acatggcgaa accgtgtctc tactaaaaat acaaaaagta gctgggcgtg
71001 gtggcgcatg cctgtaatct cagctacttg ggaggctgag gcaagagaat
71051 cgcttgaacc caggaggcgg aggttgcagt gaaccgagat cgcaccactg
71101 cactccggcc tgggcaacaa gagctagact ctatctcaat acaacaacac
71151 gtttattaat aacagaagag aaactaggtg ctgaagggac agtgggcagg
71201 gaggggagga gagagcccag actgcagaat gaatcggagt gggcagaggg
71251 gcatctccgc ccacagggac agggaactca caatggctct cacacagtct
71301 cagctgtgct gcttggggag ccagtgtgct ctcagagatc catccagacc
71351 cattatcaga gtggtttctt ctcaggaaca ccatgactca gaaagtcttt
71401 tcagggctgg aatgatggcc aggtattatg gaggccatta aaaattattt
71451 aattactttc ttaatttgta aaagtaatac atgctggtcc taagatctca
71501 aatgattaca gtgaaaaaat ggaagtgatc acacctcgtc tccccctta
71551 atactgcctc gcattattca gaaaaggtgt gaagtccaca gaggagcctg
71601 tgatctgcta ctgagcagca cacagctctt gtctcataaa gaccagagga
71651 aggatccctc agggcctggg acaaaggttt ctaacaaaag gctgtcctaa
71701 gagaaaggac aataagagga ttagctattt aatgggataa cacacaaggc
71751 acatgctgag ggaatgttct gtgagaggcc accgagagtc atcagcctgt
71801 ccttagctga ctgtctgcag tctcctgtgc cctccaataa ctaactggaa
71851 aacaatgtca tattgaaacg tttctcctct aaatttaaat atacatacaa
71901 taggtgaaat gtaccagtta gtgcacctaa aatctaataa aatatcacct
71951 aagtaaaatg tcagttcttt aggaacaaaa agagatattg accaagtctt
72001 tttttttttt ttttttgagaa ggagtctcac tgttacccag cctggagtgc
72051 aatggcatga tctcggctca ctgcaacctc tgcctcccag gttcaagtga
72101 ttctccagcc tcagcctccc aaatagctgg gactacaggc acccaccacc
72151 acactcagct aatactgact gactgagacg gagtctcact tgtcaccca
72201 ggctggagtg caatggccag atcttggctc gctgcaacct ccgcctcccg
72251 tgttcaagca attctcctgc ctcagcctcc caagtagcta ggattatagg
72301 cactcaccac catgcccggc taatttgta ttttaatag agatggggtt
72351 tcaccatgtt ggtcaggctg gtcttgaact cctgacctca ggtgatccac
```

FIG. 7 CONT'D

```
72401 ctgctttggc ctcctaaagt gctgggatta caggcttgag tcactgcacc
72451 tggcctaatt tttgtatttt tggtagagac agggtttcac aatgttggca
72501 aggctggtct caaacttaac ctcaagtgat ccatctgttt tggcttccca
72551 aaatgctggg attacaggcg tgggccaccg tgtccagcct tcaacaagtc
72601 tttttttttt ttttttaagca tttggaaggt gttatggtag gccctgataa
72651 tgcagctgca agtaggacca tgttggccct tagtggccca catcctagtg
72701 aggctgaaaa ccaggcagta agtggcggtt agcgaatatg agggcaggga
72751 agaagtggca ctgaagccag actacgaact tcaggaaga cttcctggag
72801 gaggtgtttt gatcactgcc tctcttccct gttggtgagg gatggacttc
72851 tgcctgaggg ctatggtgat ggctgaacac acaagacccg acactgggca
72901 gatgagatgg aggaggttta ttagttgcac acactgtggc ccgggaaagg
72951 aggacatctc gccatgcagg gccacatagg ggttgcacct gggaacagtg
73001 ttcgggcagg ggccacgcag gcaggctttg cagtaacaag aggagggggt
73051 gggatgagcc ctggttcccc acagaggatg tgattggctt gtctggataa
73101 ttccacaggc agactggtgg gaactgaagc ctgctactga ggggacaagc
73151 atttgtcccc tccaaatctg tgcctgctcc ccttgatagg gagagctatc
73201 tggttaggga accttatatg tggaagcaga gtggggaggg agacttgcag
73251 tttggccatc tgaggccccc tggatctta ccaggtatca aagcagacat
73301 aatactgaat cccagccagg gagggtggct cacacctgta atcccagcat
73351 tttgagaggc cgaggcgggt ggatcagttg aggtcaggag tttgagacca
73401 gcttggctaa catggtgaaa ccctgtctct actaaaaata caaaaaatta
73451 gccaggcgtg gtggtgggcg cctgtaatcc cagctactcg ggaggctgag
73501 gcaggagaat ggcatgaacc caagaggcgg agcttgcagt gagccgggat
73551 agcaccactg cagtccagct tgggcgaaag agtgagactc cgtctcaaaa
73601 aaaaaaaaaa aaaaaaaac aaaattagc tgggcgtggt ggcgcacacc
73651 tgtagttcca gctacttggg aggctgaggc aagagcatca cttgaactgg
73701 gaggcagagg ttgcagtgaa ctgacattgc gccactgcac tccagcctgg
73751 gagacagagc gagactctgt taaaaaaaa agaaaaaaaa aaaaggcaga
73801 cataatactg aatcctaatt tcaggcctta taccacaaga gatgactcca
73851 gatctgagtg gaaaataagg gtgtttcagg gaggagcatg tgcaaaggcc
73901 tggagctgag aggtagcgtg tctgaatcta cagacagttt agcagagctg
73951 atggtggggg aaggttaatg cgtgagagga aggtagggga cggatagtaa
74001 ggggccctgg aatccaccag tccagcgca tctccctgtg gcatctccct
74051 ctggcagtcc ctctggcatc tcctctactg ctaaacttta accatctctt
74101 tgcttattaa acactgaaac aataaaaagg caaacaggag cattaaaaag
74151 cctgacgatg tgatcatttc cattgattct gtgactgata actggactta
74201 ggtgaggttt acaaggaaaa gatgcaaact aagggtcggg gtagatttcc
74251 tcaaccagag ccattgttgt gtcctcaacc agacagtgga gaccaggaga
74301 tgctgagtat tcatgaggtt tatggctggc cctgcatccc agtgaagcca
74351 aggtcagaac acaggtcatc atcagaaggt cctgccctag acacacggta
74401 tcagaatctg catttgagta agattcccag gtgatctggg gcactttgga
74451 gtctgggaag tactacttgc tttacattat ctactggatt tttactttca
74501 tgaaaataaa ggacaccttc aataaatgag ttttactgc gttttggttt
74551 ttagaaatac ggtcttactg tgttgccctg gctaaattca aactcctggg
74601 ctcaaataat cctcctgcct cagcctccca agtagctggg ctccaggct
74651 cgtgccactg cacccagcta gttttcactt ctttaaggtg cataatgtaa
74701 acgtgaagat gatagagaaa gcctgtgtta gacatttgca tttcatggga
74751 ttgagccaaa tctgggctgt ttgctttctc tcatgccagg cagggcagcc
74801 aggggaggag gtgtcagcat ggcatctggc aaaggggaga agaggacact
74851 cagcagggag gagccatgac tcaggctggg gtccgtcagc ctctgggctt
74901 caccagcaat ccccaggcag agtttaatgc agccaatcaa aagtgcatag
74951 ctgcattcag ctgagccctg gatctgaagt ggctctactc tggtcaaggg
75001 ggctcaaaact ccttggctag gacttgaggc atcaaagatg acacctttc
75051 ctttgggaag tactaatgag cctactcaat tctctagatg tttcctaaca
75101 ctagtggtaa acaggagtcc cccacacaga tcctagctgg agatgatttt
75151 agagtcacaa agaaatgaga tatatgggcc aggcgcggtg gctcatgcct
75201 ataaccccag cactttggga ggccgaggtg ggcagatcac gaggtcagga
75251 gatcgagacc atcctggcta acatggtgaa accccgtctc tactaaaaat
```

FIG. 7 CONT'D

```
75301 acaaaaaaat tagctaggcg tggtggcggg cgcctgtagt cccagctact
75351 cgggaggctg aggcaggaga atggcgtgaa cctgggaggc ggagcttgca
75401 gtgagccgag atggtgccac tgtgctccag cctgggggac agagcgagac
75451 tcgcctgaaa aaaaaagaa aaaaaagaaa tgagataaat gatgcaaagt
75501 ttcagaagca aaacctgaaa gcagttatcc tgagaaaggc agttttataa
75551 agtggtaaaa aaaaatacct gttggtattg acacagtaca tggtagaata
75601 tcaatgctaa ttgaatattg actgacaatg agcatgaaga cttttggaaa
75651 ggatctacaa gaccacaaat atatatgtac aataaaaaga aagttgatat
75701 taaaagtatg ggaaaaccac ccagtttaaa ccccacaagc tcttccatct
75751 gcactcacta ccaacatttt ttttttttt ttgagaggga gtcttgctct
75801 gtcacccaga ctggagtgca gtggcgtgat ctcggctcac tgcaagctcc
75851 acctcctggg ttcacgccat tctcttgcct cagcctccca agtacctggg
75901 actacagggg cccgccacca cgcccagcca attttttata ttttttagcac
75951 agacaggatt tcaccgtgtt agccaggata gtctccatct cctgacctgg
76001 tgatctacct gcctcagcct cccaaagtgc tgggattaca ggcgtgagcc
76051 accatgcccg gccattcact accaacattt tttattttat gtattgtttt
76101 ttagagatgg actcttgctc tgtcgcccgg gctggagtgc agtggtgcaa
76151 ctgtgactca atgcagcctt gaactcctgg gctcaaaaga ttctcccgcc
76201 tcagcctcct gagtagctgg gactacaggt gtgcaccacc acacctggct
76251 catttaaaaa acttttttta aagatagggt cttgctatgt tgcccaggct
76301 caaatattgt ttaatataat agctttatta agatgtaatt cacatgccac
76351 acaatctacc tatttaaata attggtttta gtagaatcac aggtttgaat
76401 caccacaatc taattttaga acatttcatt accccaaaaa gaaatccgtg
76451 cccattagca gtcactcctc atttccccc aacacccca cccctaccct
76501 cattcccacg caaccagtaa tctacagtat ctctacagac tcacctattc
76551 tggacatttc atataaatga agtcatacag tatataatag aggcgtttga
76601 cagtcacact tgcaataaac ctcctccaac atttcaaacg caaacgtttt
76651 taattactta cataaagaag caatcaagcc atcggaattt gcaacgtttc
76701 ctactaaaga caagtagaca aaagggcctt cctagagagg agaaaatgaa
76751 gacatgctct aatacagcat cacaaccaca ggatggcact gtagacacat
76801 ggcattgcct ggctccatcc cccaccttc tccatggctc acatcctggc
76851 cacagcctgg aaacatccat acaaccttgt gggatacaat cttgggacct
76901 ggttacctgg accttggaaa tgggtatgtc tcacctaat gtacaattaa
76951 tgttgttttt caatgattgg cactgtaaaa gcagagatgt gttcttatgt
77001 ggaaaagtg aaattttgc ataagagttt aactactgta ttaaatagag
77051 taagctctag attattccag ggatcttaag tctttgcgga gaacccaca
77101 gaagttcact ttttttaac tcaaaaaat ctaagatctt aaagagaaag
77151 gcaatcaagt ttataccagc attgagcaat cctcccccct tctcctatat
77201 aagggcaagt ttaggaagat ttaaaacagt tacaggctac atttaacatt
77251 caggtaataa aatatctgca attacagtta gtattttccc atcactgaag
77301 tgcttctttg cctaagattt ctaaaactaa acagctagaa gccactggga
77351 tatgtaattg tcatgttgct cctttgaaca aatttgctg ctggtcaata
77401 aaactttttt ctcattcctt ttaaacaatc atttgtatga cattaaaact
77451 gggtcctgcc accccagagg tcaccactct caatcacatc tctttgcagt
77501 tcccgcggtg atttcataat atacttacac tgctatttcc ttcgactact
77551 agcaggaaaa gctattgttt gattgatact ccttcctctc ccgtttccag
77601 tccttcgagt ttctgatata ttattctatt acttacacaa atttgtaact
77651 taagtaaaaa aactgaaaac ctcagctcac tcactcatca attttgtgca
77701 gtctctgggc ttctaaacca cgaaagagta tgacagcctc taccaggctc
77751 cccgcaccct gttcccaact ctcaatttct gtccagtttg cttgtgcatt
77801 gttgagactg attacatgtc ctttcttgtt ctctaaacat atttgttttc
77851 cctgttttat ctgtaactgg attctaaaag ctgaaaaagc caattaacag
77901 catttacaat gttgtgatta tggaaacagc gttcactgta atgggccaca
77951 atttctttcc ttagggatcc cgtatcctga ctcctgtgtc atttaaggat
78001 aatgctgcaa atgaagtatc ctttgttttc ttttttctgag atagtctcac
78051 tctgaagctg aagataggct ggagtgtggt ggtgcaacct cagctcactg
78101 caacctacgc ctcccgggtt caagcgattc cagtgcctca gactctcaag
78151 tagctgggac cacaggcgtg tgacaccaca ttcagctaat ttttgttatt
```

FIG. 7 CONT'D

```
78201 tttagtagag atgggatttc accatgtggg ccaggctggt cttaaactcc
78251 tggcctcaag tgatttcccc acctcggcct cccaaagtgc tgggattaca
78301 ggtgtgagtc accgtgccag gctccaaaaa tcatatccct taaaggacat
78351 taaaaaaatc atatgagaaa aatagctgtg tttttaacaa ataagtactc
78401 cccagtccac ttactttgca acactttatt tttaccagcc aattttttat
78451 ttttagcaga gccataqggt gaaatccata ccacttcctt gctctggcct
78501 gagaactttc tacacaaagc catccactg ggctggccag tggggcaatg
78551 gggctggact ggatttgacc ctctctaggc ctcaggccat ctatctgtaa
78601 gatgaaggac ttccttccta tagattgtaa atctcatcct aaaacgaaat
78651 gcaacctcca ctggcgacct cttcactgg acccattagt aagatgtgga
78701 gtctgacacc aggttgcaga cctttccaca gaagcaactc tgggtaagag
78751 caagatgggg aactggaaat cagtaacatg caggaaccta tgagtctata
78801 acaaatccgt ttcctttac atctacttgt tgaagctcta ctcattttc
78851 aaatcccagc cctaacccc ttcttcaaga aaccttcttt gacctcctag
78901 tgagaattaa tatctcactc tcctaaatct cccatgtggc taagttgtt
78951 tctgtaacca gcagctatct gctcgctatg gacccccagc tcccattgga
79001 tcacacatca ttgggatctg gaatactgtc atctctacct tagaatcccc
79051 aagaaacatg acatttgtgt tccgtgtttg ctaaccttga attaagttca
79101 tacaacaaat tacttataaa gaaggatgcc ctgaagaggc ttttagactg
79151 ccctatctct tactgtatta atgtcctaaa tgtaaagata gtataataca
79201 tatcaagtgt aacgaatatt catgccttca aatgctgatc aggtgtcacc
79251 tcctccagga agcaagattt tactattctc ctgctgggag gtcagtgccc
79301 tcctacacag aaacttgctc acttgtctct tcccaaaact gccagttctc
79351 tgagggccaa ttctttctct tttatctctg tattgcaaat ggctaacaca
79401 tagaacatgc taataagcgt ttcctaaaag agtaagaaat aaaagggata
79451 atagaaaaca agacagttaa aaataataat aacaataata ataatctggt
79501 tagaagatgg gcaaaagaaa tgaatagaca tctcaccgga aagtacataa
79551 agatggcaaa taagcacatg gaaagatgtt caacctcatt agccaccaag
79601 gaaacacacc ttcaagccac agtgaggtat gactgtataa actatcagaa
79651 tggctaaaat aaggttgggt gtggtggttc acgcctgtaa tcccagcact
79701 ttgggaggcc tgggcgggcg aatcacgagg tcaggagttt gagaccagcc
79751 tggccaacat ggtgaaaccc cacctctact aataatacaa aacaattagc
79801 cgggtgtggt ggtgtgtgcc tggagtcccg gctacttagg aggctgaggc
79851 aggagaatcg cttgaaccgg gaggcagaga ttgcagtgag ccgtgattgt
79901 gccactgcac tccaaccttg gcgacagagt gaaactgtgt ctcaaaaaga
79951 aagaaaagga aaggaaagga aaagaaaggc taaaataaaa aatagtggca
80001 acataaaaaa atactggcaa catcgaatac tggtgaggat gtggaaaaac
80051 tgaaacaaac acagatttct gaagggatag aagcgataca gccactaaaa
80101 aaaaccagag tttggcagtt tcttctaaaa ctaaatatgc aatgaccata
80151 cgacccagca attccacagt tgggtatttc tcccagaaaa ataaaaactt
80201 atcatcttta tacaaaaaca actacacgaa tgttcatagc agctttattt
80251 gtggtaacta aaaactgatg tccttcaaaa agccaatccc aaaagcttac
80301 ataatggtta catttatttt tatttctgta tttatttttt gagacacagt
80351 ttcactctgt tgcccaggca ggagtgcagt ggctcgatct tggctcactg
80401 caacctccac ctcccatgtt aagggattct cttgccttag cctcccaagt
80451 agctgggatt acaggaatgc accaccacgc ccacctaatt tttgtatttt
80501 tagtagagat gggtttcac catgttggcc aggctggtct cgaactcctg
80551 acctcaagcg atccactcgc ctcagcctcc caagtgctgg gattacagg
80601 cttgagccac catggccaac cctgtggtta catttatata acatttttct
80651 gaaatgatag attttagaaa tggaggacat tgttagtggt tgccagggggt
80701 taagggatgg aggtgtgggg tggggggatg tgtagttata aaaggaaaac
80751 actagggatc cttgttagtg ctggaactat tcaatacctg ggctgttgtg
80801 gttgatatat gaatctaccc agttgataca attatatgga acttaataca
80851 cacacacaca cacacacaca cacacaccac acaaagaaac tgacagtctg
80901 aaaaagatca gtggactgta tcaatgtcca tatgatggtt atattatact
80951 atagttttac aaaattttg gtaccaaaat tatcaaaata gaaaataact
81001 ttttcttttt ttagacagag tcttgctccc caggcaggag tgcagtggtg
81051 cgaccttggc tcattcaacc tccgcctcct gggttcaagc aattctcctg
```

FIG. 7 CONT'D

```
81101  cctcagcctc ccaagtagct ggggttacag gtgcccgcca ccatgcctgg
81151  ctaattttt  gtattttag  tagagatggg gtttcgccat gttggccagg
81201  ctggtcttga actcctgacc tcaggtgatc cacctgcctt ggcctcccaa
81251  agtgctggga ttacaagtgt gagccactgc acctggctga aaataatttt
81301  ttaaaaccc  accaaaatgt tagcatcgtg gaaacctggg aaaagtaaac
81351  aagggacctc tgtattattt cttacaactg tatgtgaatc tacaattacc
81401  tcaaaataaa aagttaatta aagaaacaga gaaagacatg ggagaaagag
81451  taccatgact aaatgaatgg gcttttttt  ttttggcaa  ctgtcaggac
81501  ttaaaaaaaa aaatttagaa taggccaggc tctggcctca gagagcttat
81551  tgtctagttg gataacaatg acttccaatt caataaagga tggaggaaga
81601  tgagggagct gtagctgagg cagtgaggaa aaatttcaga gggaggcagg
81651  ctgagaggta ggaggacagg gatggagccc agaggatggt gtgaggcccg
81701  tgggtccagc ttttgccctg ctcagccctg tggcacaaac agtagtgctc
81751  aggggtactg tgtacattaa caatgtgtgc aaccatcgcc accatccatt
81801  tccagaactc ttcatcttct aaaactaaaa caatgtgccc actaaacact
81851  gattctccat ttcttcctc  tctcagccca acacccagca ctctatttg
81901  tgcatctatg aatgtatttt aggtacctcg tgtaagtgaa atgagaccag
81951  tcatgctaag cctcacaacg gtgatacgct ctgagaaatg catcattaga
82001  cagttttgtc attgtgtgga catcatagag tgtattcaca caaacctagg
82051  ttgtgtaaca cttacctcac acgtaggcta tatggatagc cttttgctcc
82101  tgcgttacaa acctgtacgg cattactgta ctgaatactg taggaaatta
82151  taacacaatg gtatttgtgc acctaaacac agaaaaggta atgcactgca
82201  ctacaacatt atgacagcta tgatgtctct agacaatagg aattttcag
82251  ctccatcata atcttatggg acaaccatgg tatattcagt cccttattga
82301  ctgaaatgtc cttatgcagt gatgactgta tttgtccttt catgtctggg
82351  ttatttcact tagcatagtg tcttctaggt tcatccatgt tgtagcatgt
82401  gtcagaattt cgtttctttt taaggctgaa taatattcca ctgtatgcag
82451  gcactgcatt ttgtttattc atttgctggt ggacatttat gttgtttcca
82501  ttttggggtt attgtggctc ataagtctgc tgctatgaac actggtttgc
82551  aaggatctgt tggagtgcct ggtttcaatt cctttgggtg tatatgtaga
82601  agtggaattg ctggatctta agataaatgt tcagctttct gaggagttcc
82651  cacactgctt tctgcagcgc tggcaccatt ttgcattccc accaacagtg
82701  caccacagtt caaacttctc cacattcttg gccaacactt gttatttcc
82751  tttgttgtta ttgtttttt  ttttttaata gtactcatcc taacgggtgt
82801  gaaggagtat ctcactgtgg ttttgatttg catttcccct aatgactgac
82851  tagtgatgct gaacatattt tcatgtacat attgagctct ttggaggaat
82901  ttctattcaa atccttgcc  tacctttgag gttttttta  attgttaaga
82951  atgtaagttt taaaatggag atatcatcac ttggaatttg aaaccactgg
83001  gctagactgc cccatgggca agatgaacca ataattctca aagcatttgg
83051  taaagcagag caggggccat tttcataaga atctgagaac aagatctgcc
83101  cactcatcat gagggcaagg ggtctgcagt gaatcttgag cccccctccc
83151  ctgctgcctg gtaacctcct cttcggtctt taaaaccccta gtgaggccgg
83201  gtgcagtggc tcacgcctgt aatcccagca ctttgggagg ctgaggcgga
83251  cggaccacaa ggtcaggaga tcgagaccat cctggttaac acggcgaaac
83301  cccgtctcta ctaaaaatac aaaaaatta  gccgggcgtg gtggcgggca
83351  cctgtagtcc cagctgctgg ggaggctgag gcaggagaat ggtgtgaacc
83401  cgggaggcgg agcttccagt gagcccagat cataccactg cactccagcc
83451  tgggcgacag agcaagacta tgtctcaaaa aaataaaat  aaataaataa
83501  ataaataaat aaataagaaa gaaaccccgg tgaatccttc cttcctcggt
83551  gccacctcta ggcctggaca gtcttatcac tcaccagact gcatgacaat
83601  gatttgtttc cctctctgct ttccctacta ttaaagctcc ttaagggcgg
83651  ggcaaggttg attacatgca ataaacacca aatacacata cagtgagatt
83701  ttatagataa tcccaggctg attctccaga cttccacag  ctatccctga
83751  atcatgtggt attagccggg ccacctaatt ccttagtcct tcctaattt
83801  ttttagtga  tagcagagat gacatgggtc cagaggtgtg acttgcaaaa
83851  gtcctttgtt gaaacattca gtatattaaa aaatgctct  cgtttgattt
83901  aaaaaatagg accattgcag acatgggcag gtctggtggg tcagtgtgca
83951  ctggcactgt ctaaatagca ggtcatcctt ttccgggaag gggcagtggt
```

FIG. 7 CONT'D

```
84001 tctacatgag gacactgccc ttgtgttta tgtaaaaagg aagccaaata
84051 gaccaacaaa cacttgtctt ttcttcatga agtaggtaat acaccagtag
84101 caactccctg attcttccct gaaacaatgc taagagctgg tatcccttcc
84151 ctgtatcatc acacttgtcc actcccactg cagcccacgt caatcctgct
84201 gcatcccacc ccaggaaggt cattcagatc aaagtcagaa aaagcacatg
84251 gtgaaaagga ggtgagcctg ccaatatcag agttccaagt gacatctctg
84301 aacattctgt gattctgaga ctggctggct cttaccctaa cagaactcac
84351 aaatataaat cagcaaacac aggcccacca ctttaggctg caccatccac
84401 agctgattct catcaataaa gacgccatgc aaaaacaaac aaactaggtg
84451 tgggaggcag aggcccagc ttcagaatga gacctgctat tatggtttta
84501 aagattgtaa gggctggacg tgatggctca cgcctgtaat cccagcactt
84551 tgggaggctg gggcaagcag atcacctgag gtcaggagtt caagatcagc
84601 ctggccaaca gtgaaactcc ttctctacta aaaacacaaa atacaaatat
84651 tgtgtctgga attggtgggt tcttggtctc aatgacttca agaatgaagc
84701 cgtggaccct cgcggtgagt gttagttctt aaagatggtg tgtcagaagt
84751 ttgctccttc tggtgggttc gtggtctcac tggcctcagg agtgaagctg
84801 cagaccttcg cagtgttaca gctcacaaag gcaatgcgga cccaaagact
84851 gagcagcagc aaaatttatt gcaaagagct aaagaacaaa gactccacag
84901 cgtggaaggg gacccaagcc ggttgccggg gctggcttgg gcagcctgct
84951 tttattccct tatctgaccc cacccacatc ctgctgattg gtccatttta
85001 cagagagctg attggtccgt tttgacaggg tgctgtttgg tgcgtttacg
85051 aaccttgagc tagacacaga atgctgatta gtacatttac aatcctttag
85101 ctagacacaa cagttctcca agtccccact ggactcagaa gcccagctgg
85151 cttcccctag tggatcccgc accagggccg tgggcagagc tacccgccag
85201 tcctgcgccg cgcgccggca ctcctcagcc cttgggcggt caatcggaca
85251 ggtcgctgcg gagcaggggg cagtgccctt caggagcggg ggtggtgccg
85301 gctcgggcat ggcgggctgc aagttccgag ccctgccccg tggggaagcg
85351 gctcaggccc ggcgagaatt cgagcgcagc gcggacgggc cagcagtgat
85401 ggggaaccca gctcaccctc cacagctgct ggcccgggtg ctaagcccct
85451 ccttaactgg ggccggcagc acccaccaag ccagcgccca cccagaactc
85501 tgcccgggag cgccgtgcgc agcccgggtt ctcgccggcg cctctccctc
85551 cacacctctc cacaagcaaa gggagccgct ctggccgcgg ccagcccaga
85601 gaggggctcc cacagtgcag ccgcgggctg aagggctcct caagcatggc
85651 cagagtggat gccgaggctg aggaggcacc gagagcgagt gaggcctgtt
85701 agcacgttgt cacctctcaa tattaaaaaa tacaaaaaaa taaaaattag
85751 tcaggcatgg gtggcacgcg cctgtattcc cagctactca ggaggctgag
85801 gcacaagaat cgcctgaacc tggcaggcgg aggttgcagt gagtcaagat
85851 cgtgtgtgtc tgtgcctggg tgacagagtg agactccgtc taaaaaaaaa
85901 aaaagactat tcaggggctt ttgaataaaa tctgctctaa ccacacaaag
85951 accgaagatc aaagccactg aaaacactac ttactatttg ccaggcacca
86001 aaattatctg tggaattgta gagaatggag acagttatag ttcctcctgt
86051 gaattcatgc tttatattaa atgaactgta cagtactttc tttcttctcc
86101 cttaaaattg ttttagact ctggggcatg aagtttatgt taaataacca
86151 aataaacatg gaaggttatc agctccaaag tctttaacca caacgtatga
86201 tagagatcca gccatctgga actaagattc atgtttgagc tcaacaagca
86251 ctgaggatct aaggatcaga tgaaaggtgc ctggtcaaca gcaaagggcc
86301 acatgcagga tgttgctgta attgggaagg cagggctcca ctaggtgtca
86351 ggcgtgatat ggttaagctt gagcaaaagc aagtacaaca gattgtattt
86401 ctttcttttt ttcttgttct gtcacccagg ctggaatcca gtggtgttat
86451 cacggctcac tgcagcctct cagactcctg ggttcaagca atcctcctgt
86501 ctcagcctcc aaagtagctg ggaccatagg tgtgcaccat catgccaggc
86551 tgatttttct tttttaatt gtagagacgg ggtctcgtta tgtggttgag
86601 gttggtctag aactccttgg ctcaagcgcc tcctccctca gcttcccaaa
86651 gtgccaggat tacaggtgtg agccaccatg cctggccgag attgtatttc
86701 tgacattcat ggctactttc acctctccgg gcttaaattt cctaaccaag
86751 aaaaaaatag agtcaagcta tatatatata ttagtcaata tatgtctagt
86801 gaatgaataa gtaataagga gaggcaggct ggatctgcat ctccacctt
86851 tgacagagtc gctcaccaat ttccagcctt gagcacagca cttggaagat
```

```
86901 gcatgttgct tactgagagg atggtgagga ccctaagcgg aggcccaggt
86951 agtgtctgtc agcagagggc caggttggtg ggaggggcct gcttcagcac
87001 cagcacttcc agtgggcatg agccatgagt tctacacctg ccaagaccca
87051 cgagccacag ggaagtcaag ctcacagcga ccaccagggt agatccctga
87101 ctggacatga tgaggtcttc gaggactcct gtactgtcat ttctatgata
87151 acatgaaagg caggcacctg tccctgaaga agacctgact ttttagagac
87201 agacttactc agtacataaa cgtaaagtga catgaggtcc agatcacttt
87251 ccagtacttc agcagtaaca atgaaaaagg gagggagaga aggacaaaaa
87301 cagaagaaaa agtgacagat gggcaagtgc agcaaaactt gaaaatgctg
87351 aatctgctca ctgatactgt actagtctct ctacatttgt gaatgtttga
87401 aattgttcac tgtaaaactt aattttaaaa agatacatag cttatgcct
87451 gtaatcccag cactttggga ggccgaggtg gacagatcac aatgtcagga
87501 gatcgagacc atcctggcca tcatggtgaa accccactc tactaaaaat
87551 acaaaaatta gctgcgcgtg gtggcacgcg actgtagtcc cagctactca
87601 ggaggctgag gcaggagaat tgcttgaacc agggaggcgg aggttgcagt
87651 gtgccaagat tgtgccattg cactccagcc tggtgacaga gcgagattcc
87701 gtctcaaaaa acaaaacaaa atacaaaaca aacaaaaaaa atatatgtga
87751 tacatgttaa agttaaaaaa aaattataaa aaggtacaaa gcaaaggata
87801 aaagcctctc tccctcctga ctcccaatca cgtttcccag agatgaccac
87851 tgttaagttc catggtagcc ttcaagaatt tttcaggttt atattaataa
87901 gcagttataa atatttaaaa tattttctcc ctgctatgaa ttttctatt
87951 attaacccag agggtgatga ggaaaatttc ataatactta tttaagttct
88001 gtatatcaaa aaatttggtt taaaaaatac agtaaagttc ctactggaca
88051 tatgttataa aatataactg aactatattt aattgagctg ctaacaaaat
88101 cagcttaaaa attaaaatgt attatagcaa ataaagaaag gccagtctca
88151 ttttctctct aagatgtccc aggcatgaaa ttttttttctt tttttaagat
88201 ggtctcgctc tgtcgctcag gctggaatgc agtggtgcga tctcggctca
88251 ctacaacctc tgcctcccag gttcaagcaa ttcttctgcc tcagcctcct
88301 gagtagctga gattacaggc acgccacc acgcctggct aatttttggta
88351 ttttttagtag agacaggttt tcaccatgtt ggccaggctg gtcttgaact
88401 cctgacctca ggtgatctgc tcacctcagc ctcccaaaat gcagggatta
88451 caggcgtgag ccaccacacc cagcccaggc ataaagggt tttaacaacg
88501 tattttatag acttaaagac agctataagt caaagctcag atcaaacaaa
88551 tgattaagtt atgccagcta tttccattga taatatccaa tttaaagagc
88601 atgctcaatt tactcatttt aatccttaaa gaaaaattta gcagaaaaag
88651 tccttaaaga aataaaaaga acacatactg aggctgagtt tatatttgaa
88701 tgtatctgtt tttttgttgt atgtttgaat gaagacctag agaaaacatg
88751 gcaacattca ctttcaagag tgagagaatg aagtggagca ggaatagaat
88801 cagtacataa atcctgtcaa catttattag catttgcaaa tctgactcac
88851 aaaacctcag cctaatcaga ctggattttt gcatgtcatg acaacagcat
88901 acaacattgt ttctggaggg atcagctgcg gcagcctcct actgtccttt
88951 ggtgacaagg ctttaatgac tccataaatg tatgctgccc agctgctgcc
89001 cgcttaatta gacgatgatt tccacttgat tgaacctgcc cagcagccag
89051 ttgtcaccta acattcacag gagaccacac tggtctcttt cagaactacc
89101 aggatcaaac agtcacacga gttctatggt tcctacaaca tggcagtata
89151 ctgtttgatt taggacttga atcatatttc tccctttta agaatatacc
89201 cttctctgcc agaaggttgt tacttctcag attaaagatg tgaaaggaaa
89251 ccttccaagg ctcatcttaa ttggacatat acatcatcac tttagtatac
89301 agggatggga tgacaaatgc taatccgggt atggaatatg caaggagga
89351 ttcacactaa gaggacagag aagagaatta catttactga actctggcaa
89401 gtgccaggtg ccttacatct ttgccattca aacacggttc atgaaccaca
89451 gcctggcact cacttgggag ctggttacca atacagaatc ttggatgatc
89501 cctggatgat ttgtgtgcat ggccaagctt gagaagcact acgctaagtt
89551 ataaggcttt atttaattct cacagccgtt tgaagaaaac attatttcca
89601 tacttcacag gtaagaaaac taagaaaatt tccttccttc ttttcctcct
89651 cattacagaa aggatttgca ggggaagggg gcatgcccaa gtttctgagc
89701 tggtcatcgg gaaagctggc attcaagggt gcatctgctg catcccaaag
89751 gcccttgttc tttccacctt cccccaccgc cccaggctcc ttggatgatg
```

FIG. 7 CONT'D

```
89801 gtcagactcc acctagaacc gtgtttagga actgatactg cattcattct
89851 ttcattcatt catccatgaa tttattgagc tagagtctcc ctctgtcacc
89901 caggctggag tgcaatggca caatctctgc tcactgcaac ctccgcctcc
89951 tggttcaagc aattctcatg cctcagcctc ccgagtagct gggattacag
90001 gcacctgcca ccacgcccag ctaattttg tattttatt aggacggggt
90051 ttcaccatat tggccaggct ggtctcgaaa tcctgacctt gtgatccgcc
90101 cacctcggcc tcccaaagtg ctgggattac aagcctgagc tcacgcctgt
90151 aatcccagca ccttgggagg ccgaggcggg cagatcatga ggtcaggaga
90201 tggagaccat ccctggctaa cacggtgaaa cctcgtctct actaaaaata
90251 caaaaaaaat tagctgggca tggggcagg cacctgtata gtcccagcta
90301 cttgggaggc tgaggcagga gaatggtgtg aacccgggag gcggagcttg
90351 cagtgagccg atcgcaccac tgcactccag cctggaccag agagcgagac
90401 tctgtctcaa aaacaaacaa acaaacaaaa aaaacaaaaa caaaaacaaa
90451 aaacaagcct gagccactgc acccgatctg gtactgcatt tgaaaatgca
90501 acctgtggca tgtatgaggg tgacaagttt tagtcatata catctatcag
90551 aatgactaaa aacaaagta aaaaacacaa aaatgctaag ttttggtgag
90601 gctgtggggc aacaggaact cgcacacaat gctagtggga atgcacaaca
90651 gtacagccgc cgtggaaagc aggatggcag tttctactaa actgaaagaa
90701 tcccattcca aggcctcggc ctaggagaaa gaaaatatg cccacacaga
90751 cttggatgca gatatctatt agcagcatta tttgtaatag taaaaaacta
90801 ggaataaccc atttgttcat taactgataa atggataaat gaattgaaat
90851 acatccatga ctggaatact actcagcaac ttacgttaaa tgaagactat
90901 gtatgtatga tttcattttt atgaaattat aggacagcaa aactttaaag
90951 acagaaggca gacgggtgtt tgttggggct ggtgatgggc actgggatca
91001 tcttcaaagg gacatgagaa aactttact agaagcgtga tggaaacgtt
91051 ctatactacg attgcaaggg tggttacaca actctacaca atcacccaaa
91101 ttcaccaaac tgtacacaga atgggtttta ttatacataa attataacaa
91151 taaagctgga gggaggaaaa ggggaattta gaaaagtggc tgataaccat
91201 acaaatatag gtatatctca acagctttca ctataataac aataatcagt
91251 ccaaatacaa aggagagagg ccaggcgtag tggctcatgc ctgtaatccc
91301 agcactccgg gaggccgagg cagctggatc acttgaggcc aggagtttga
91351 gaccagcctg gcaacatgg tgaaacccca tctctactag aaacacacac
91401 taaaatagc tgagcacggt ggcacgtgcc tgtcatccca gctatttggg
91451 aggctgaggc aggagaactg cttgaaccca ggaggcagag gctgtggcga
91501 gctgagatcg cgccactgca ctccagcctg ggcgaacaga gtgagactgt
91551 ctcaaaaaat aaaattaaat taaacaaaat acaaaggaga aatacagtag
91601 caatgaaaat ataaaatgtt ttgaaataaa ctttaagaga ctgtaacaga
91651 agatttaaac aaattgagac ctacccagtt cttagaaggc agactgtatt
91701 ataaagatat catttaatct caaactaatc tataaagtta agaaaaccac
91751 aatcaaaata ccgagtatta gaacttggca aagtgaaatt attttttatt
91801 tttgagacag gatcttgctc tgtcgcccag gctggagtgc agtggtgtga
91851 tctcagctca ctgcaaactc tgcctcgggg ctcaaacga ttctcctgcc
91901 tcagcctcct gaatagctgg gactgcaggt gcatgctacc acgcctggct
91951 aattttgta cgcacctggt cagcaaagtg aatttaaaag tacatctgga
92001 aggatagatc ataattttaa agtgttgaa aagaatagt ggggagaagt
92051 ttgctttatc agatattgaa ctacattata gtgctgaaat tattaaaaca
92101 gtggctagaa ctggaaccaa aagattcctg aaacagaact aaattcaaaa
92151 atccccaaac atatccatac atataaaata ctttagtata tgataaagct
92201 ggcatctcaa ataagtgggg aaagaatgga ttagtcaata aatggggctg
92251 acaacacttt cttgcccttt ctccccaaaa gcgtaataaa gtgtgggtga
92301 aattgtttgt actaatatat gaacaccttt tatagatcat taaggaaaag
92351 acaaacatcc ccattgaaaa acaggctata gaaggaggat cccaagatct
92401 acgccccaga atctcgtccc aaagcctagc accaaaacag caaagcagtc
92451 ctccttcaag aaaactgaag gcagctggtc atggtggctc acgcctgtaa
92501 tctcagcact ttgggaggct gagacaggcg gatcacgagg tcaggagttc
92551 gaaaccagcc tgaccaacat ggtgaaaccg tgtctctact aaaaatacaa
92601 aaattagctg ggcatggtgg cacgtgcctg tagtaccagc tactcgggag
92651 gctgaagcag aagaattgct tgaatctggg aggcagaggt tgcagtgagc
```

FIG. 7 CONT'D

```
92701 caagatcacg ctactgcact ccagcctggg cgagagagag agagaaaaaa
92751 aaaaaaaggg acaagaatta gagactggaa ttgtggcagt gggcagtgag
92801 gaacagacgg tgatgtgaac tggagaaggg taatgcccag cttcagagag
92851 ggcgtggcac agccactggg cctcaagatt tctcaacgaa aaaccattca
92901 caggtgttag gtgggatgca tggagagcca gccaaggccc aggttttctg
92951 tgacagctgt gcttcaccct gcaggacaag gctaatcaga ctacaccatg
93001 acaaaagtgt ggaagcaaca accaggcaga ggtttattag gaaacaggtc
93051 aacctccatg gccaagcaca catcagacag cgagagctgc ctgccgcgtc
93101 tgcacttta cccttcttcg gccatcctct cgcccagacc ttcatcttca
93151 aaagaaccaa gagcccccag cctgccctga ggtgcctctg gagctaccct
93201 cctgctcttc ctccgcccac caccaaacct cctgcagggc tttcatctac
93251 tgcccagctt ctcctctacc tggcctataa gcctttggct tctggagcct
93301 ccctcccatc aatcccactc tcaccattga cttcctggtt gccaggtgcc
93351 tcaccttta ttttctttct ttttttttaa tggtgctaca gcaatttatc
93401 agtgttcttg aaattccatt ctgtggatcc caggacccca gcactctcct
93451 ggttcgtggt ctttcccact ctctcctagg atagatattt taaaagattc
93501 tgctcttatt cctcagctct ttcacccttc tgttctctct agctcagcaa
93551 aagcagtcat acctggggct tcgtgctatc tcccccaact cagaaaagaa
93601 ttcccagcac tctctcttct gccctgactc tgtctctcca actcaattta
93651 cattttcaa ttgccttctg gccattctct ctctcttctt tttgagatgg
93701 ggtctcactc tgtcacctag gctggagtgc agtggcgtaa tcatatctca
93751 ctgcagcctc aatctcctgg gttcaagtga tcctcctact tcagccttct
93801 gagtagctgg gatcacaggc atgcagcacc acacccagct aattttcgt
93851 agagatgagg cttcactatg ttagcaaggc ctcactatgt tagcaaggct
93901 ggtctcgcaa ctcctagcct caagcaatcc tgcctcggcc tcccaaagtg
93951 cttattacag gtgtgagcca ctgcccagca ctattctctc ttaactgcac
94001 acgaggaccc ccgactcata gttctaaagc cagattttgc tgtcttagtt
94051 aacatgatca ccattaccca tgttgctcag ggcctaagcc ccaagatcat
94101 gtccacccc aatctacaag tggccacttt gacttaccac attctcccct
94151 ggaaagtctc tcacagttag ctttcctccc cattttaagt tccaacacca
94201 cctcagcttg cctctctctt ttttttaaat gactccccac actacagcag
94251 ttgcttttg ttgctcttct tgcccctcaa ctccatcctt tccaatccaa
94301 cctgcaccat gttgagagac aattctccat gaatatctca catcctgcac
94351 tgtctgggtc tctgagcaaa gacatttata tcaattttaa gaatgtttct
94401 ataatgagcc tttccagagt agtaaacctg ggagacagct ccctccagag
94451 aggttctagg gtggtaaaga tcaagacctc accttctcct cctcagaggt
94501 ttacattcct aagataaggt ctctccagag agaagtatgg acaggccacc
94551 accagctcac aataagatgg acgcgtagtt ctggagttcc tttcttgtaa
94601 cgcatcccac tgcatgtaca ggcagtaaca tctggccttc attatgttgt
94651 cctgtggggt ttgggccttg gggaatcaaa ctggactacc ttgttaactt
94701 ctaagttggg taaaatctcg gacgctagag tttctgactt aacacatcac
94751 cactaaatta tctttatgaa gatctgcttt ggccacgtga cttccctgct
94801 tgaaatcctt cagtggcttc tcactacaga atacaattct tacctgtcac
94851 ctttccagct ggtcctccca cttcttatgt aaaccctgtg ctcctgtcaa
94901 tctggactac aggatgtgtt ccatacacag gcattcatat cttgcctcat
94951 gtttctggcc atgcctgaat gctatacata gattgcagaa gagataaaat
95001 tttatccatg aagcaccagt gcctaggctg cccacagcga cctcagaatg
95051 gtgaccccac catttccttc ttctagtatg ttgccatggc tccttccagg
95101 taggctgatg ggaagtcagc ctgccctctg ctgtagtcat aacgagctga
95151 actgatgacc agtgctgggg cccaaggtga ctgcactctg gttggacatc
95201 tgggaaatga actgccctg ggaatgcttg gcttgaaact gtccaacagg
95251 atagctttca atttgatggc agccaaaaaa cctacagagc tcctctcttt
95301 aagaagtgtc agggggtggc caggcgcagt ggctcacgcc tgtaatccca
95351 gcactttgga aggccgaggc aggtagatca cgaggtcagg agatcgagac
95401 catcctggct aatatggtga accccgtcct ctacaaaaaa tacaaaaaat
95451 tagccgggcg tggtggcggg tgcctgtagt cccagctact caggaggctg
95501 aggcaggaga atggcgtgaa cccgagaggc ggagcttgca gcgagccgag
95551 attgcgccac tgcactccag tctgggtaat agagcgagac tccgtctcaa
```

```
95601 aaaaaaaaaa aaaaaaaaag aagtgtcggg ttaaggagag gcaactcatc
95651 ttctagtgaa caagtgagtt ttaattttgg ttctccccta agctctacat
95701 cttagtctta gcttgtccca cacttctggg tattcttgca ataaactccc
95751 aagcaaagac aacatgggca tgtattttct tgcagcctca actgcttaat
95801 tcaagtgctc tccccactga tctctgagac acatgtacaa agacgttggt
95851 agatgcattg tttgtaatga cagaaaaatg tgtccactaa tatgggctgg
95901 ttaagtgatc gtattcatca aatataagat acatcccaat ttagagacat
95951 taaaatatca atcaaatggc ctacagtagt tacatgatgt agttgattct
96001 tctaatatgt gaaaaaatgt gggtcttaga cttggagaac taaggtatgg
96051 tgtattcaca cagtggacta ctttgcagct ggggtaggta atggcacaaa
96101 aggaggtgtg tgtcgtgtta cctgtaacaa cctgagcttg aaaagtaaac
96151 agtcttaaac caagtggtga acacacgcat atagtttaag tattttttaca
96201 gcttttttgtt tgtctaaggt atgttaaaca ttttttctttt ttttcccaag
96251 atagagtctt gctctgttgc ccaggctgga gtgcagtggc ttgatcatgg
96301 ctcactacaa cctccacctt ccaggttcaa gcaattctcc tgcctcagcc
96351 acccgggtag ctgagattat gggcaccgtc accacacctg gctaattttt
96401 gtatatttag tacagacggg gtttcaccat gttggccagg ctggtcttga
96451 actcctgacc tcgtgatcca cccgcctcag cctcccaaaa tgctgggatt
96501 acaggcatga gccactgtgt ccgatatgtt atacattttt atatatatac
96551 attctgatat gctatataca gttataccca gccaatatgt tacacagttt
96601 tctctcactg ggcctagcaa catttttgtt atgttataca ttttgttata
96651 cattttttct aaccgggcct agcaatctgc tttatctccc ttgttctgtg
96701 ggaaaccttg tgttcaagtg atagcttaaa aatcaattct cggctggtgg
96751 cggtggcggt ggctcacgcc tgtcatccca gcactttggg aggccaaggt
96801 gggcagatca tctgatgtta ggggtttgag accagtctgg ccaacatagt
96851 gaaacctcat ctctactaaa aacacaaaaa ttagctgggc gtggtgacgg
96901 gcgccgtaa tcccagctac tcgggaggct gaggcaggag aatagcttta
96951 acccaagggg cggaggttgc agtgagccga gatagtgcca ctacactcca
97001 gcctgggcaa cagtgttaga ctctgtctca agaacaacaa caaaaaaaaa
97051 gacaaaaaaa aaaaaaaaga attctataaa taaaggagtt gagagaaaca
97101 ttcactgtcc cttatctcta catgttgatt atcagaataa aaagaattcc
97151 agcaacatca gtcatgggca caaagccaac ccgtaaacat ttacagaact
97201 cgatgattac ccaaaactcg gcttgctttc tcaatactac tgactttggc
97251 ttcacattag ccacaggtgt gtctagagtt aaacaaggtc aactttacaa
97301 aaaaaaaaaa aaacaaactg atacttgggc atagtttaaa aaaaacttaa
97351 aagtgtgtgt gtgtgtgtgc gtgcgcgtgt gtggtggggg gcggggcatt
97401 tcaatataaa tgccttaaac acaaccttcc tggctatttt ataaaatggg
97451 ttgaatctct aaggacacat atttcctaag acctcgactg atacacagag
97501 tgcaaacttg ggagccagac tagactgcct cagaatcatg ccagctgtgt
97551 ggcactggaa agtcacctaa ttttgcagcg cctaccttca cctctgtaaa
97601 atggggaaca ataataacta atttatggat gctgtaaaga tctgaaattt
97651 taaactcagt aatgcgcctg gcacacatta gacacgggtg tttcgtttgt
97701 cttggcaaag gcttcgggtt ttgcgacaat agccttgctg cctccggagc
97751 aagcatctct ccttgccccc tctgggcat ttaaaaatga cctcaattct
97801 actctcaatt atgtccagtt caacagttac gtgcaggtta caaagccgag
97851 gaagctgagg tatcttctaa actaacatag cacgtacaga attttttttaa
97901 agtttggtgg aggaatcggg agcacaaggt aagctgcgct ctgttcacag
97951 acctgggaat cagaactccg gccgccgcgg cctccaggcg cctctcagct
98001 aacagacttc ctgcagcagg gggaggggcg gccagctcgc tgcaaaaagc
98051 cgcaggaccc cctcaccccg ccttgccgcc ccgctccca ctctctggga
98101 tggggagtgc agggtctagg cgatggcact taccagcgcg aagtgcacca
98151 gcgcgtcgta gcagagccag atgagcgccc cgcggtccgc cgcccctgc
98201 ccgcggccca ggcgcaggcc cagggcgcag cccgccgcca gcagcgcggc
98251 gcacagcagc agcgaaccgc cagcctcggc cccagctcc cactcagcgc
98301 ccatgcttca ggcttccgac gccaacggcc caggaccatg cggcagagga
98351 aagcagggag agaaacgacg gggcggggct ggccgggaag gggcggagcc
98401 ggatggccaa ggaggagcgg agctgattgg ccaaggcggt ccggggaggg
98451 acggggctcc ccggccgggt cggggccaga gcgaggattc cgtgcccgcc
```

FIG. 7 CONT'D

```
98501 tcgcaccctg gccagcctgc tgagtccggt ggttttgcca ggtgccgccc
98551 atggaggttc cgtagaagga acgtgctcac caacttgcgc aaccgcctcg
98601 accaaacctg ttcccaaacc gagcccaaag gattggtaat agggccacac
98651 cttttgatgt tgtttcgctt ttaacaaggc tcaaacttta agccacaaag
98701 tgaagcctag gtagtggaaa ttttgccagt agaccggggc agaattttag
98751 gggcaaaagg ttttaattag gctgcagcaa gccttaccag ggaggctggg
98801 ggccaaggga gttttcagcc accagccggc ttaaagcctt tatggcctac
98851 tctgacaatc tttccatttc ttaaaaatcc agaaaagtag aagggtgggt
98901 gagaggagcg gtaagtccta ttggcttggc gatagatgcg tttaacctgt
98951 ggcaggccag gtttcactat cgcaggcctc catcacaact gcttcagcac
99001 tgagtggtta aattaaatat taaaagctga ggccgggcgc ggtggctcac
99051 gcctgtaatc ccagcacttt tgccaaggc gggcggatca cgaggtcagg
99101 aaatcgagac catcctggct aacacggcga aaccacgtct ctactaaaaa
99151 tacaaaaaat tagccgggcg tggtgacggg cgcctgtagt cccagctact
99201 ccggaggctg aggcaggaga atggcgtgaa cccgggaggc ggagcttgca
99251 gtgagccgag atcgcgccac tgcactccag cctgggcaac agagcgagac
99301 tccgtctcaa aaacaaaaa aaaattaaa agctgaaaga gtcagtgccc
99351 ataccaaa gtctggaatg taacaaaagc ccaccaagag ttttgcctag
99401 gccttttcttg ggccttgaag catgacaaga taactaagga attttttaaca
99451 ggacccgttt aggattaaac aagtttttatt gggggtctga agaaactccc
99501 caggcctcca aaaacaagtt tattgggagt ctggaggaat tccacaagcc
99551 tccatgattt agcaagagac aaaataaggg taatcatccc agcacccaga
99601 cctatttaga ttaagtaaat ttactgaggc tccagaggaa ggtcttcagg
99651 attagaagtt gttaatcact tacgtcttta gatgaatgca ctcttacacg
99701 tagacatata gcttagaagg tatatacgct ctggaaaaac tttgtaatta
99751 tgagttggtc tggcaataat ttccagacct tctccctgta accggttgca
99801 gaaataaaaa ctcttcttcc ccagttcatc tgcacctcat tattgggctg
99851 cccaacccc agtttggtcc gggaacaaac ctacattatt taacatcaca
99901 acaaccctat gaggtcggtg aaataagcca gtcacaaaaa catacttatg
99951 attccactta caggaaatat ctaaaataat caatttgcag aaacaaaata
100001 gaatgatggt taccaggggt ggggcggggc gggagtgggg gggggcgcg
100051 gggaaaagtg gagtgttatt tattcggata gtttgatttg caagatgatg
100101 ttctggagat tggttgcaca acaacgtgaa catactttac tgagctgcac
100151 acttaaaaat ggttaagatg gcaaatttta tgtgtatttt acagttatta
100201 aaaaaaatgc tggcactgaa cacaagaaat ttttccctta gtcacttcct
100251 ataccatttt ttatagcagt taacaccaga tagaatgatc cttgtttaca
100301 cacttattgc taatctcctg ccactataat gtaagtcttc aaggccaggg
100351 gttgtggcta gcttttttat tgctgtatcc ctggcaccta ttacagagtt
100401 tggcatatat tagctgctca gttaaataac tggcgactga gtatggtcaa
100451 tctagccacc tatgctctgg atcctgtcct gtaactaact tatcatcctt
100501 tagggaccac tcggcccacc tccccttcag agcaaaatag aaacttaatg
100551 aaaaaactga tcagatcccc tgtcttcatg tcttgaccct gctcctcagt
100601 cctttctact ctggtttctg ccttatcaca ctgatatagc tctcactaag
100651 gtgactactg gcctccacat cactgaaccc caagaacagt tcatttttctt
100701 agtgtagttt acttctcagc agcatcccag cactgaaata ttttttccttt
100751 ggttttctga gaatacagcc tccttagcca ttctgtttcc tttgcaagtg
100801 catcttccac tacaaatgcc tagtgaatgc tgcagctcca caacccagtc
100851 ctcggccctg ttctcactcc agacccaaa tccaggcagt ctcatcctta
100901 ccctctgctt taatgaccag caaaacctgc agagaactca aatctctagc
100951 ctggtcctat tctctggact ccagaccagt atttccaact gccctacttg
101001 acagtcactt ggatgtctca atataaccca aactgagctc atcactttcc
101051 accccaatgt ctgattctcc ttcctatctc atgttacttc cactcatcag
101101 ttactacaac ccggaaacct agaaatcatc cccgatactt ctctctcccc
101151 aaacttggca tctaaggcat caccaactcc tcctcagcag ccaagtattt
101201 cttgattcca tgcatttcat ggacctgttc accatctcgt ctgtgcttca
101251 ctcactaatg tgaccagcga cctctacatc actaaatcca aaggacgttt
101301 tctgtcctta gccttaccaa ctagtgatct ttattaatct attatccctc
101351 ttgcttaatg atgatcttca tatagaatac caaatccttt tttatgactt
```

FIG. 7 CONT'D

```
101401 actagactgt ggggtctggc ccctccctat ctctttagcc ctttcccatt
101451 cccctattaa tcctcctctc cattataatc tttcatctag ctatacttgc
101501 tttctttcac ttcctcaaat accccatggt gcttcccaca aggctttgta
101551 cagactcttc ccactgctgg aaagcttttc cagtcaatgt gcccaataaa
101601 ctcctgcctt ttcaccacga tcagtgaaat tttggctggc acttttttaag
101651 ggctcaacat tagcctggtt atcacctttc tcagtagcca atttcctcta
101701 gtatgtgtat cattgtatac ctctttttt ctaacatttg tcaaaacttg
101751 tcttttttt tattcctgtt attttacaa gtatcctgtg ccatagcaca
101801 gtacctggca cgggacagag tattcagtat tcgaatgttt ctaaaggctt
101851 agtcagaatt cttatttata taagactgaa gacatcgaaa ggatacatat
101901 gtagaatgtg atctcatgag aaaaactagg ctgaagtaaa tatgaaattt
101951 attcttatgt ttagagttga aaagggtaga tgcccaacga tttgggttaa
102001 agagagctga tgataaagag ggtgtgactt gatcacaaac ctaattatga
102051 tgaagctggt aaaataactg aaagactccc cccacattaa tagaatcaaa
102101 agtccagata atggaatgtt cccattcatt ccaaagtact cagaaaccag
102151 tcacaccaca ctccttattg ttggaatcct tggagtacat cacgctgaca
102201 ggaaccaggt ccagcaatga ctttataatg agaatggatg aaatgcaagg
102251 ggtgttcgag taaagaaag ctgatttaaa aaatggatga gtctcctctg
102301 ctatctggaa ataacaaagt ctactcccaa tcaaaaacag ttaatttaca
102351 atgatggaaa tttaagtttc ttctcttt gagacagggt ctcaactctg
102401 tgcccaggc tgaagtgcag tggcacgatc tcgggtccag tgtatggcag
102451 cctcagcctc caaagtagct gggactacag gcatgtaccg ccaggcccag
102501 ctatttatt tatttatttt ttttgtagag atgaggtctc actatattgc
102551 ccaggctggt gtcaaactcc tgggctcaag tgatccactg acctgggcct
102601 cccaaagtgc tggcattaca ggtgtgggcc actgcaccca ggttaagaaa
102651 ggatcttgta gcaagcaaag ctagccaata aatacaagct ccctcaaaat
102701 gagtaccttg tttctcaagc tcttctaact tactcctgca ggaatgtttc
102751 cataaaatac cctgcctcaa aaatcagatt ttatgtttaa aatatgtaaa
102801 atgtatactt tataacactt tggcttgtat taccaataaa acttttactt
102851 accacctagt aaagttgctg tcccacgaaa gtgttcctta tcttatggtt
102901 tctcacacta tttggcacaa ggccccatgc atctttgggt accacagttt
102951 aagggaattc ctcaagaagg tgtatggcaa tttgctaggg tagggaaggg
103001 ggatgctgta gaagaaattc cctgcagaga atactttctt tatggcatgg
103051 ctcggccata gtttctgttt taataattt aatagatgat tgtaagtttt
103101 ctgatgaggc caatctctca acaatgcttc aagtgatctt caaactatgc
103151 tatgattttc tagtacaact ccagttttcc ctagataact taaagatttt
103201 caactacaag tgtttgaaaa acactgccat agggtgttga gatttgggca
103251 attaacacat ttgattgttt tacaaccctg ttttttagcc acaggataaa
103301 tttaagaggt aactagttgc tccatatttc tatttcttta tcccaagtcc
103351 cttgaaatag atgttcagta ctacctggag tttcctacag atgatttggg
103401 aaattaggtt aggcctgcct tcaattttc ctaaaactca gaatgaagaa
103451 aaggcacatt tgtgtctcct ttcttcatct tatgcatctg aggaaagcct
103501 gggactgttc atacaacaaa aaagtcatga tttaggctgt ctcatttgag
103551 tggagttttc tataggaatt gattaggac agtggtttac aatcagggat
103601 ggttttgggc cccagatgt ttggcaatgt ctggagacat ttttggttgt
103651 cttaacttgg ggagaggaga gaggtgctac tgctatctag tgagtagagc
103701 ccagggatac tactaaacat cctacattgc acagggcaga tgacacacaa
103751 caaagaatta tccagccaaa aatgtcaata gtgcagggtt taaaaaaccc
103801 caatttaggc caggcgctgt ggctcccgcc tgtaatccta gcatttgggg
103851 aggccgaggc aggcggatca cttgaggtca agagtttgag accagcctgg
103901 ccaacatagt gaaacttgtc tctactaaaa atacaaaaat taggtgtggt
103951 ggcaggcgcc tgtaatccta gctactcggg aggctgaggc aggaaaatcg
104001 cttgaaactg gaaggcagag gttgcagtgg gtcatgccac tgcactccaa
104051 cctgggctaa agagcgaaac tccatctcaa aaaacaaaaa aacaatttag
104101 gcctaagtta gttgagggat tttatgggca aacagtggca ttaggttgca
104151 ttcccacatc cctttttccca cacattgtat atagcacttt tggagaatca
104201 ttctatcact gttttttagc tatctaaaca acatttatac tcacagcttc
104251 atatacagaa attatatttc ctttccccca aaagagttta agtaaacttt
```

FIG. 7 CONT'D

```
104301 cccagtttaa ctagggttta aaaaattaac catcactgta agacaacgga
104351 cattcatgaa tgtcaggtgc tcttgtttac ttgtttatcc gcattaacta
104401 atccctgaa aaggatgaat gacgcttct aaaaaatttt cttttcatat
104451 aaaaatagaa ttttttaaa gatggggtct tgctatgttg cccaggctgc
104501 tcccaaactc ctgggctcaa gtgatcctcc tgactcagcc tcccaagtag
104551 ctggagctac aggtgtctgc caccaaccac gcccttcagg atgacccttc
104601 tgaaagaaat gatggcaaga ttgtatgagt actatcacat ttacttatac
104651 accaacttct tttaaaagta atttgcagtg gcattataca aaagtaaaca
104701 tttctatact caaaagtttg gctgctcctt tgttcttta gttaatgcaa
104751 gatttcattt agtgccataa actttaccta acaggttaaa acttttaggt
104801 ttgctctgat tactattttc catagttaca tgttttcaag gggtagccag
104851 gtcttaaagt ttgagttttt gtttcatcag tcacaatcat accatcatct
104901 caaataaatg gactttttct aagttatagt atttaaacct gagacacata
104951 gggagaatgc catgtgatga cggaggcaga gactggagtg atgcagctac
105001 aagccaagga atgccaagga ttgccaggaa ccaccagaag ctaggaagag
105051 gcaaggaagg atcatcccca tcgaagtccc cagacagagc atggctcagt
105101 catcaccttg atttcagact tctggtctcc agaagtggat gacaatacat
105151 ttctattgtc tgaaaccacc tggtttgtgg tactttgtaa tggcagctta
105201 ggaaactaat atagattttg gcaattctta tttgtcacag aatagtctca
105251 aatctagcat tattatcgat catcctggtt tgttagagtt gagatggaag
105301 aggaacccct cttaagggcc tgccaggtgc cccaccaagc atggaaataa
105351 aggaaaattt tgagttcctt caagggaaat tccaggcacc tagctagccc
105401 tatgaataaa taagaaactt gataagcaag agagtaatag tagcttaaaa
105451 caacagccaa ggaagtcaca ggatgtttgg ttccttatag aaactaaaga
105501 taacatctta acatatgtcc ctgagttgtt cttcagacac ctggaccccc
105551 accaaatggt ccactggcca gggaagggg aactgaggac tgagctctga
105601 ctgccattct ttgttctaaa tgtcttcctg aggggcctat aggaagtcac
105651 gcccatgggg cagacttagc attctttct gctgaccca agtttttga
105701 caaagctttg attccttaat caactgcaaa taagaaaatc tgtgaattca
105751 cctatgacct ataagtcacc cctgccacc ctcggcttca agacagccca
105801 cctttctagg ccaaaccatt gtgtactgat gtacaattct gcctgtaatt
105851 tatgctttcc tgaaattcac ccctgccttt aaaaacccttt gcttgtaaag
105901 ccatgaggga agttgggtct taagtgtgag ctgcctcatt tttcttgttt
105951 ggtgccctgc ctgcagataa atgcccctcct ttttcctgct gcaaaacctt
106001 gctatgaatg tttggcctaa ctgtgccagg tgaacagact ccagtttagt
106051 tcagtaatat ggtgtgaagg agatattaaa atacagtaaa agagtaattc
106101 atgatttacc tccattgtga tttttaaaaa aataattcca aatttaaatt
106151 taaccataca gaaaacaaac aagttatttt cagaaataag ttttcaatgt
106201 tttatcatat ttgatagcag ctttttttat tggttacaaa acctaagccc
106251 atatacaaaa ttaggaacac atttagatgc ctcttttgaa agaacgtttt
106301 agtcttttta aactgagttt aaaaaaaaat aacaatgcaa tttttaaaca
106351 ctgttttgaa aacttaaaag tgcagcaata tacttagttt cctttatcta
106401 cgaaatggtg caattccaat tcaaaactgg taaggtcaca aattgaatca
106451 aggaaatgca tacaagtgtc tgcactactt gatgctaatg ttcacttaaa
106501 tgttagtttg cactttaaaa catgagagga aataggaatc atcacagtag
106551 aggcccaatt ttaatcataa tgtgtgcaaa ttttaaaagg taactgtcag
106601 ttaagtaagg aaagtccaga agaaactaaa ctggaagggg tacggttcac
106651 aatatcaaga agatttggac ttttaagggt ttcaccgaag tttgtgacct
106701 taattagctt ttacgttgtt attcctactt ttagcgaaca ccacacagtt
106751 tcaaaaattt agactatagt gtccgaacag gatgcagtta ccatatgaag
106801 ctttaactca aaatttggat aaagaaaaaa aggcacaatg aacttcaact
106851 caatttatg tgcacaagag ttgaaaaatc tgagccacct taaagagaaa
106901 ttgattctaa aatttataaa acctataaat aatcagaggc caaaccacta
106951 tattaaaaca gattctctag caagtaaaaa tcttgcagtt taaacatacg
107001 cttgtatcca cttagatac aagacaaaac tcactcttta aagtggctcc
107051 accttggcag atacatatat ttgtaatgaa tgcacacctg ctatgtgttg
107101 tttatcagtg aaaacacccc agctgattca caaagctctg atggcatctg
107151 tctcatcttc atcacagtaa atacacccc caatggataa ctaaattagt
```

FIG. 7 CONT'D

```
107201 ttagattttc tatcccttca catcaatgca ttgggaaatt atacccagta
107251 aacaagagca acaataccat ttctgtgaca gcacaaatta tttagtttaa
107301 aaattttttaa atccatattc tttcattaat aactgggtca gacaatttac
107351 caaaagcaat aacttgacat agtaataccg gattttgcag aattacttag
107401 agatcactgc aaatcaggtt tatgttaaat aactgcaaat tactcctcta
107451 cacagatccc tgtctgaatc ttttaatatg tgaagatgct ttttgagtag
107501 gatctgaatt aactttccca atactcaaag aatgaactct tatgacactt
107551 ctaaatagtt gctggtttgt tgccaaccac attatcaaaa gcactggtta
107601 ctaagtaaaa aatattttaa gactaaatta cagtaaacat gaaagctcca
107651 cagtttaaac ccaatataaa tcaaccatat ccaattatca aattaaaaca
107701 aagaatatta actcctgaaa gctgaaagca agatttttt aaaaaacatc
107751 accaatgggt attttagact tttgcagttt tttttttgttt gcttttttgtt
107801 ttgctgtttt tcctttatac tcagggactc ttgctttcaa cttaaacaga
107851 agttcaagtc cataacaggt tgcagctcag gtaaaatacc atgcacagca
107901 tttgattact tcaaaacagc aggaacacac aggctgaaga gagtggtcaa
107951 atagggcttg ctgttctcaa aaattaggta taatggcaaa agcattaata
108001 tccatatcta aagttcttcc tccaaccctg gcttctgagg cagataataa
108051 acacatcaat tactggtaga tgaagtagtt ttttttttt tttaaactta
108101 tctgtttatt caataaccaa gtttcttgtt tttaagttac ttttttttgtg
108151 tcagttccac caatgaaaat catttggctt gtactttaaa atctattctt
108201 ccacataaag aatatgaaaa tatgtttgtg gaggacaatg atggaggctc
108251 agatcacact gcacctcttt agtcttccaa cttgtatatg catcatacca
108301 aagtgtcttg atccacagcg caccattttc caaggagta tcagtgggca
108351 gctgacatgt caccactatg gaatatttat tctaaactgg agactgcagt
108401 tgtcagcctg tggcaccagg gaacagggaa aaatagggta gttgagattg
108451 ttaaggagag ttctaaaaca gtttaggaaa tcatgcatat gcatttacag
108501 tccatgtgat agtgactttt ggcaactgca aagtgactga gacatggctt
108551 gctttagaag catcaaaaca aagaggcatg tgtgtttttgg agcctttttgt
108601 tgctgttgtt cttatcattt ggtagccatc tggtggtgct tcatattgaa
108651 tgtgggaaag atgctgcact caactgaatt taaaaattaa attctttttgt
108701 ttgaaggttg gctgttggat caaaattgta ggtacctcct tgtgttgctt
108751 caggaatgag gcagggatct tcatcaatct gtaaaaaaca agaaaaaaat
108801 ccttattagg ttatgatact atacattatg atgtaagtgg aattgacttt
108851 ttacctctta gcaaataatt ctatgtgaat gctttaacca actaaaaata
108901 ttcgagtaaa tcaataattt tattaagaaa tttaacaatt taaaatttaa
108951 cacgtttcga aactgcattg ttaagtttct gtatctggga cctagattta
109001 tttaacctat ctgaacatat atcacttata taattactat ttcttcctag
109051 ttaatagatt agaaatgaaa caagaactgt tttacaact ttaccttata
109101 atgaagtttc aaagtattta agagaaagtg actgatggaa tgtctaatag
109151 aaatacagta caaacttatg tcatcctaat aataaaagga aaactcttag
109201 taaatttaca tcatgtatag gttttcattt acatgaagat acacgctatt
109251 ttaatatcta cttacatcat caccagagaa atactgatct atgatttcaa
109301 atgctaattt atatatgtct tcattttcat gttgctgtaa aacttcaatt
109351 ttctccaaac ctggtaaaaa taaaataatc aaaataactg gttaattgat
109401 aaggagatac taatcaaaac cacactcatt ttaatcatgg agaaatccta
109451 aggaactcag aacacactgc tcccccatct aagatagtgg tttgtctaaa
109501 aaacagacaa aacacgggggc tgcttctagt tggaggacca gaatcccact
109551 aatttttttcc ttcttagaag cccttgaggt acccggatcc ctgaggcaga
109601 cagtctaaaa aaacacccaa acaatccatt tgacagaggg aagctgtggc
109651 ataaatatgt aaagagactt atttcaagtt atatggcaag tttgtgacag
109701 tactagaacc aactcccca cagtgcttta atataaattt actaatctat
109751 ttttttttttg agacggagtc tcgctctgtc acccaggctg gagtgcagag
109801 tgcagaggtg tgatctcggc tcactgcaag ctccgcctcc tgggttcatg
109851 ccattctccc gcctaagcct cccaagtagc tgggactaca ggcgcccgcc
109901 accacacccg gctaagtttt ctatttttta gcagagacgg ggtttcacta
109951 tgttagccag gatgatcttg atctcctgac ctcgtgatct gcccacctcg
110001 gcctcccaaa gtgctgggat tacaggcgtg agccactgcg cctgggcatt
110051 ttttcttttct ttcttttttt tttttttttt tgagacggag tctcactctg
```

```
110101 tagccagggc tggagtgcag tggcacgtct cggctcactg caacctccac
110151 ctcctgggtt caagtgtctc ctgcctcagc ctcccaagta gctgggatta
110201 caggtgccca ccactatgcc cagctaattt tttgtgtttt tagtagagac
110251 ggggtttcac catgttggcc aggctggtct cgaactcctg acctcgtgat
110301 tcgcccgcct tggcctccca aagtgctggg attacaggag tgagccactg
110351 cacccggcca atcttattaa tcttactgcc tcataaagta atttgtatct
110401 ttctctttgt tttccaaatg ttattacctt tatataacca caaaatgagt
110451 ttttagaacc ttataattgg tataaagat ataaagattt aaattttgaa
110501 aaactttctt taaaaaatga atagaggtct tatgtcctat agccacaatg
110551 aacctgggag aaaatatttc cagaacagat atcatagaat gccttcattt
110601 atatttccaa tatatttact ccacacatca tatacatgtt tatcaatttc
110651 acaccttaat attcttcctt gaaatgtctt tttgaaggtt attttaaaat
110701 agttgcaatt ttttcttata tactaataaa ccaaaagaat gggggaaatc
110751 gttgccaaag tgctttatac aattataaaa tattaatatg tatcctatta
110801 ctcctataga caaaagtaac tatattgata aaaagctgaa gagtagtaat
110851 tctctaagtt gctcaaactt actgtgttat gaacctgact acaattttta
110901 attatcttaa tagtaagaag atctggattt taactttgct tctatcacaa
110951 cctacttctg tcaccttgga caagactcct taaaatctgt gggataattt
111001 cttctcaaga aaccctcccg gctgggtgca gtggctcacg cctgtaatcc
111051 cagcactttg ggaagccgag gcgggcagat cacccgaggt tgggagttta
111101 agaccagcct gaccaacacg gagaaaccct gcctctacta aaaatacaaa
111151 aatttagccg ggcgtggtgg tgcatgccta atcccagc tactagggag
111201 gctgaggtag gagaattgct taaacccggg agacggaggt tgcggtgagc
111251 cattacactc cagcctgggc aacaagagcg aaactctgtc tcaaaaaaaa
111301 aataaataaa taaaaaataa ataaataaat aaataaataa ataaataaat
111351 aaataaataa atagaaagaa agaaatcctc ccagtctgaa tattctacgg
111401 tactactgca tttgtttct cttaaaataa ataaataaat aaacaataga
111451 atattcatat aaagtagtca atgaaatgta aaatctaaaa catgacatta
111501 tgataaacta atttaaggtt taaacatgtt agtacatatt gaacatgtac
111551 atttaaaaac agaattttaa catatgtttc acatgtcatt aaagaataat
111601 acagtatgtc aaatcacaat tatttctcat taaaatttca aagtaactgc
111651 cacagtaata acttcaggat gtagttgtgg aaatcctaag aatcattaca
111701 agattgaaac aaaatatcta ggtgactcag aagtcagtaa ccttttccaa
111751 ctatatgaaa taatatttcc taaagtgggg tccacagaat tacatggtaa
111801 taacacacaa aaaagtgtt tcattgttaa gaagtttaag aaatgctgga
111851 ttaaataaag ctttaaaatt tatgtagtgt tgtaagggct cttaaatttg
111901 ctgtcatgca ctgtgacttc aagagaagta ttagtgtttc ctaaaatgca
111951 atgtcaggcc aggcgcagtg gctcatgcct gtaatcccag cactttggga
112001 cgctgaggca ggtggatcac ttgaggtcag gagttcgaga ccagcctggc
112051 caacatggtg aaaccctcgtc tctattaaaa acacaaaaat ccactgggtg
112101 tggtggtgtg cgcctgtaat cccggctacc tgggaggctg aggtgtgaga
112151 attgcttgaa ctcgggaggc agaggttgca atgagctgag attgtgccac
112201 tgcactccag cctgggcgac agagcaagat tctgtctcca aaaaaaaaaa
112251 aaaaagctat gttgtcaatc tctagaaggc tatacagtga ctttcacaac
112301 ctgattttgc aaagtatgga ctactgtctt ctggaaaatc ctcttggaat
112351 gcaaatatag tgaataaaga aaagcaacat actgtgatca tttaaaaaca
112401 acgtatccta gtaattttct gtctagtaag ttgactttaa agaacttatg
112451 tttcagagtt ccagtgctca aatactcttc ttccatcaat ccactcttac
112501 ctccacattc ctctattatt tcagctattg tgcttgcttc atcaccggcc
112551 attatcagaa tgtttttag accatctaga accacctgaa ccacttgaga
112601 atctttcact gacagtaaat tacagaacgg tggtattaca ttctgctgta
112651 caaggtactc aacctagaca acaaaagaga agaaatattt ttatttatat
112701 aattatctat ttcccagtag ggtgtcgtgc tacatggaag gctgaggcag
112751 gaggctatct tgagcccagg agttggaggc tgtagtgcgt tatggtcatg
112801 cctgtgaata gcaactgcac tctagcctgg gcaacatagt gagactccat
112851 ctcttaaaat aataataatt atcttttccc caaaagaac acaatacagt
112901 cagcaactac gaaacataag agagcagcat gctttccagt attaacaatc
112951 atgacagtta caggttttca aactcacctg atctttctg ccacttattg
```

FIG. 7 CONT'D

```
113001 ttaagttgct gattgcccaa gcagcttctt tttgtgttcc aaagtccccc
113051 tgaaggttaa aaatgagatc ataaaatgga ctctttatcc aaaaagtctt
113101 ggttattaac agattaacag acacggtgaa ctcataatat gaccaacctt
113151 agcaagctga tgaattatca taggaattaa tccagcatct attacagctt
113201 gaacttgttg ctggttgcct gctgttatgt tggaaaggaa ccacactgct
113251 tcctataatt gaacaaaata tagggcacct ttatttgaaa aataatacct
113301 ttaatgtctt tctaatatat tttatataga caataacaaa atcacctgaa
113351 ttacgttaaa gagactgcac ctaaaaagtg attaggtata caaaatcttc
113401 cattttaaac aagttataag gaaatttcca ttaattatat ttgggctcca
113451 ataacctggc atttatccat tcattaatat ataggcctac tataagctag
113501 gcattattct aggaaatggt gattttatag aaatgaacaa aacagaaatc
113551 tttattcatg gagcttacat gtctgtgcat tagcttcctc taaaagacag
113601 aaataaatat acaactgaat ttcttttttc ttttcttttt tttttgaga
113651 cggagtcttg ctctgtcgcc caggttggag tgcagtggcg tgatctcggc
113701 tcactgcaag ctccgcctcc cgggttcacg ccattctcct gcctcagtct
113751 cccgagtagc tgggactaca ggcacctgtc accacgccca gctaattttc
113801 ttctattttt agtagagacg gggtttcacc gtgttagcca ggatggtctc
113851 gatctcctga cctcgtgatc cacccgccta ggcctcccaa agtgctgaga
113901 ttacaggcat gagccaccgc gcccagccac tatacaactg aatttctaaa
113951 actacttaaa aactacttct aataaaggtg atttcttttt taatttaaa
114001 aaatatttac tcacaagata tagtcattca agtattccat aaaaattaac
114051 catctaacta gtctagcatg ggtctatata acataaatat tctaaaacta
114101 agggatttat aagtcataaa cacgtctgtg agctgtttac aggttagtat
114151 cacatgtgta tcttcctctt ccacaaatga atttgttttg ccatccaact
114201 gtggtaagtt gttaataatt gctgaatctg tgtttagagt acatgggtgt
114251 tcactatact attcttgcac atttttgta gatttaaaaa gtttcaaaca
114301 gaaatgctga gggaagaaaa tcaagttggt aacttctact tccagggtcc
114351 tatgatagtc tcaaaatgca agtaacaaat tttcaaggca aaaaattttt
114401 gaagtaacta attgcttgct gaagttgaga tggcatttct atgaaatttt
114451 cctctacccc ccacgatacc ctcacttaaa agcatactac atcacaggcc
114501 ggaacctttc tctgctgact tctgcccagc ttcctcactt ctcagttgtt
114551 tccaattatg gaatatattc atttagctaa aaaaaaaaaa atcacctata
114601 ttgttaaaaa tttcttagt aaaagtaact ggcccagagt ctgaaagtct
114651 ctggcttctt tgtcttcact ggaacaaatg tatctataaa atgtgttttt
114701 tgacaccata cttttctata agaacccaac agtcaaatta tactcaagca
114751 actatacaaa tatagttatg atgacgaaga agaaatgatc agttctgctg
114801 ggtttgggtg atggtagtat attaggcaga taaaacttta gtaaactaaa
114851 tgtaaattta ttcttttc ttttcctt ttttttttt tttgagacag
114901 agtcttgctc tgtcgcccag gctggagtgc agtggcacaa acttggctca
114951 ctgcaaactc cacctcctgg gttcatgcca ttctcctgcc tcagcctcct
115001 gagtagttgg gactacaggc gtctgctacc acccggct aatttttgt
115051 aatttagta gagacggggt ttcactgtgt tagccaggat ggtctcaatc
115101 tcctgacctc gtgatctgcc cgcctcggcc tcccaaagtg ctgggattac
115151 aggcatgagc caccatgcct ggccaactaa acgtaaattt aaaccacaat
115201 gagacaccac ttcacatcta ctaggattgt cagtaatttt ttttaacaga
115251 aaataaacgt tggctaggat gtggagaaat tagaattcta gtaacactgc
115301 tggtgggaat gtaaaacagt gcagctgcaa tggaaaacgg tttggtggtt
115351 cctcaaaaag ctaaacccag aattaacata tgatcgagca attctacttg
115401 cagttatata tccaagaaa ttgaaagcgg gaactcaaat aggtatttgt
115451 atgccaatgt tcactgcagc attcttcgta atagtgaaaa ggtggaaaca
115501 accgaagtgt ccatcaacag aagaatgtaa aaacaaaatg tggtgtatac
115551 atacaatgga atatttattc agccatagaa agaataaagt tctgacacat
115601 gctgcaaaat gaatgaacct tgaaaacatg ctagatgaaa taagccaggc
115651 atgaagactt attacatact agtaagtaca tattacacaa ttaataataa
115701 acttgtctat gaagcttgaa atcttaaaaa gagtaatttt ttatgatcct
115751 tgaatttagg cacctcgtct ttgggtccaa actaattttg ctgggagatc
115801 aaaatttta tgatcggttt gtttaaaaaa ataccagccc attcaaatgg
115851 cagattttgt ctgcactttc aagcggctac taatttaatg attgttgcta
```

```
115901 tgctcagtct acttaaatag aaacacaggt agtctaaaaa tgtttttac
115951 tctgtgatga ccaggggcagc acctaccaga agcgattaaa agttgaaaaa
116001 ggctgggcgc ggtggctcac gcctgtaatc tcagcacttt gtggggctga
116051 agcaggcgga tcacaaggtc aggagttcga gaccagcctg gccaatatgg
116101 tgaaacccca tctctactaa aaatacaaaa attagctggg cgtggtggcg
116151 ggcacctgta gtcccagctt ctcgggaggc tgaggcagga gaatcgcttg
116201 aacccaggag gcagaggttg cagtgagccg agatcgtgcc actgcactcc
116251 agcctaggca acagacagac tctgtctcaa aaaaaaaaaa aaaaagttg
116301 aagaaaaaca tttgcagagg tgatttaaaa taattctcat cttcgctgca
116351 gtggcttttta agaaaaacat acaagtagca atagaaacaa ggagacagtt
116401 aaaaatgaga cacagaaaga aatagcataa tgaggacatt atatgcctta
116451 ccttatttat cttctctttt gggtgtgata agagatttgg gaagtgtgac
116501 aggacatcac aattgagaac aacctgggtc tgctcgtcgg tgccagtcac
116551 tatgttgcca actgctctga gggctgctgt ctaggtggg gataaaatgt
116601 tttctataaa tttatttgct tataagacta attctatatt tttcataatc
116651 ctgagaaaaa gtaaaaatgc aaggcataaa taacacttat ttcatccttt
116701 cacaaagcac caagcagtct gagagctatt ctgaatttta aatagtctct
116751 tgtgaaaaac tgaaacttta tgaaaaaaaa aaattgtgtg aaaattggtt
116801 ggaaaaagat tcaaaaaata aaggaaatt aaaattttag aagaagtcca
116851 gtttcttaag gctgggcatg gtggctcatg cctataatcc cagcattttg
116901 ggaggccgag gcgggggga tcacctgagg tcaggagttt aagaccagcc
116951 tgggcaacat agtgaaactc catctctact agaaatacaa aaattagctg
117001 gtgtgatggt gcatgcctgt aatcccagct actctgaagg ctgaggcagg
117051 agaatcactt gaacctgaga ggcagaggct gcggtgagca gagatcgcgc
117101 caccatactc cagcttgggc gacagaacaa gactccatct caaaaatata
117151 tataatattt taataaacgc ctggaatggg cacacacttc cacctagaaa
117201 gtcactttgg taaagcagga tgaacagatc taataagtgc ctaccctaa
117251 ttagagtggg agagagaaag aagaaatgca attaggttat tgcaattatt
117301 tgggggaaag atagagtctt gaactaaatc tgttgttcta gatagataag
117351 gagagacaga tttgaaccta tataagaaga attgaaatga ttttgtaatg
117401 gaatgggaat tgcaaggagg aatcaaaatt tctagcttag gccatgctgt
117451 tcactgaagg tagacaagga agaagagcag gtttgtggga gatgatcgtt
117501 tcatttctgt ctagttaacc acggaaagct tgaaggagtt cttagatgat
117551 atgtataaag ggtcaagaac aattggctat acaagtgtgg aactcagcaa
117601 agaaactggg tgagataaag atttggaaat caacaaaatc aggctcaggg
117651 actagcagaa gaatgtggaa agataagcac ttacagatag aattaaagcc
117701 tagctgtaca agttaactgg ttatagcaaa cacaactgta tacaaataag
117751 aaaaattttaa aaatacttac ttgaactttg acttcctgat ggctcagaag
117801 gggcacaaga aagggcacaa ctcctgaatc aataaccatc tgtatctgtt
117851 cattacctcc atctgtcaag tatgacagag cccaaacagt gtctacaaga
117901 atctacagga aacacaaaag aaaaaccatt ttacatattt gtttgaatgc
117951 tttacttgtt caacacacct caggagtagt gacagaaaaa gtaaccaaat
118001 ttcaagtttt agcttagtgg caaaaatatc tgcttagctg attaatctat
118051 taagtagaaa gtaccttatc tttctttcag tgcctacctc agatcattct
118101 tcacagaaaa tgagacacag aagtctggga aaacttctat tccaacttct
118151 gcatttatgt atcagacaga tgaatttaaa aacaggcaga aaagtaattc
118201 tccctgccct cacaaattag ctacctaata atcccacaga aaaacactat
118251 ttacaagaat gaggccaaca caccatactg tttcaagttc agaagagaac
118301 agaaaggtca tctatttact ctactggttt tccaacatat ttagcaatac
118351 aatttttcag gctactaaag taaaccaata aagaaatga cttggcactt
118401 taacttcatc tggggaaaaa actgttgaa aatctcctga aatgtgtccc
118451 caactgaagt ataaacctgg agtataaacc atgccctagg cctatcctaa
118501 ctttgcaact acatagaaga aaacaggctt agcgatctgg tgattcattc
118551 aaggtcaaag atcttgtatg tggcattgct tggtgtcgtc acagaggaat
118601 ataagcactg gttgtagctt atgcaaaatc aagatgtttc ctattaggtc
118651 atccaaattg aagacatcac atcttttgc cctaaaataa tagcaggcac
118701 ctgaattcac atacccttca aaaaggata tagatgaata aataaaatag
118751 aactacacat ataacccaca cccttcagc attactaaga gtcagagaac
```

```
118801 actaaaaatt tccattatct gtaagaggag aaaaaattaa attctagctt
118851 ttgtctggac ctcttgcctc aagactgtgt aaaagagagg acagaagctg
118901 ggcctaagag ctgagcccac ctaccagccc atttccCact ctggaagtga
118951 ggaggcctcc ctgctggagg tgtctgcaga tgctgggtct gagaacaaag
119001 tctggctact gcccaccctg gcagtaacag taactagatt tacctagaaa
119051 caggggtctc aaagcataac accaatatgt gtaggctaca atggaaaata
119101 acccttcata ccaagatcca ggaaattctc aaaagagaaa agacagtcaa
119151 cagatgccaa tattgagatg acacacatat tggaattatc tgacaaggac
119201 ttgataagat tttaaagtaa ctatcataaa aatgcactgg tgaacaatta
119251 tgaacacatt tgaaacaaat ttaaagtggg aattctcagc aaaaaaaccc
119301 gacatgatag aaggggaaa aaaaaataaa tgaacccaaa gatacatcaa
119351 tagaaatcat ccaaactgaa taacagaaaa aaaaaaagat taaacagaaa
119401 ttaactctca ggaacttcca gcacaataac aatagatcta atatttgtgt
119451 cttcagagac cctacaagga aaggcggagc tgaaaaaaat atgaagaaat
119501 atgttccaaa tttggcaaaa tagataagtc tagaatcaga ttaaaaaatg
119551 ggaggttgag gcaagaagag aaaatagaat aagctcatgc atcattgcac
119601 aggtaagaga cagaagtaaa aaaatatatc atttaaaact gtcaaaacag
119651 atagtaagag agcattaaaa aggtgtaaga ataaaggtaa ccactagaac
119701 aaaaatacaa acttccccaa ataccaaaag aaaattgaga aagacaaaag
119751 tatgcttagc agagaaaaaa aaaaacacag ggacattatt tcacaaaatg
119801 acagttcaaa tcaatctatc aacctatgtg aatgggccta actaacctat
119851 taaaaaaaaa aaaagatttt caaattggcc ctggctctca aaacaaaacc
119901 caattccacg ctgtatacaa gagacacaca taaaacaaag aatttggaaa
119951 ggctaaaaat aaagggatga gcaaaagtat gccaagtaaa tgataaaaag
120001 aaagctgagg ttgtaaccct gttaaaagac gaccagtaga atttaatcta
120051 aaagaatta caaagaaaaa aggatacttt acaaagttaa atcccacaat
120101 ttatcatgaa aatacaacag ttataaacat ctattaacca aatagccctg
120151 caatcactgt tttaaagcag agaataaaca cacacacaca cacacacaca
120201 aatatatgta aaaacatact aataatagga ggttttaaca tactactgtc
120251 atatgaggga agtcaaatag gcaaaaaata aaggtataac tcttatgaat
120301 atatattgaa ctttataccc tgataatggc aactacaact tgcacatgta
120351 caaatatcat attaggttca aagaaaacat caataaatta cctaagtcag
120401 aaacattata agcctatcac aaggcaaaaa acttatacat taataaaatg
120451 aaaaccaaaa aggctttct atatagaaat ttaatagcct tatattaaac
120501 agctcttagg tgaaacacac acacacacac acacacacac acacacacac
120551 acacaaaaca gaaaaaccca acaacaaaat ttctattttt cttttctttt
120601 tgagacagag tctcactctg tcaccccggc tggggtgtag tagcacaatc
120651 ttggctctct gcaatctctg cctcctaagt tcaagtgatt ctcctgcctc
120701 agtgccccat gtagctggga ttacaggcgc gtgccatcac agtcagctaa
120751 ttttgtgtt tttagtagaa atggggtttc accatgttgg ccaggctggt
120801 ctcaaactcc tgacctcagg tgatccaccc gcctcagcct cccaaagtgc
120851 tgggattaca ggcatgagcc aaaacgcctg gcctaaactc aacaaaattt
120901 ctaaaaagtt aaaacaaaaa tgccacacat cagaatctat gacatttatt
120951 taaaacagtg attaaggaa aattcatagc cttaaaatt tatacaaatt
121001 tgtctgaacc catagaatgc acaacagcaa gagtgagtga acaacagtgt
121051 aaactacgga ttttgggtga ttatgatgag tcaatgaaaa atacaaaagt
121101 aatgagataa agaatagaaa aatcatagat ctaactaata aactgaaacc
121151 ctggttctct gaaaaaaaca aaaacaaac aaaaaaacaa ctaagaaaaa
121201 gtcctaccta acttaattag aaaagagcag ggaggggca caaatacaca
121251 aaatcagaaa tgataaaata acccttaaaa taataatta gaacaaaaaa
121301 ctaccctgca cactttaatg caagtaaaca tagatgcaat gaataattta
121351 ctagaacaat agtttataaa aactgacctt ctttagaaag agtgcttaaa
121401 caagccaact tccatatcaa aaataaagaa aattatcatg aaactaactc
121451 cacaaaaaag taccaaatcc ccaaaggatt taagagggaa actatcaaat
121501 cttcaaaggt cagacagact tgatgctata taattgttc cagagtacag
121551 aaaatgaagg aagcataaca ttaacccctc aactttaata aaacaataga
121601 agtataaaac ttaatacatc atgattatag caccattaac taatggtatt
121651 aacataatta aatttaatat taatatttgt aattaatgta aattattgcc
```

```
121701 taataaattg aacaaaagct aaactgcaaa ccaatatcac ttacgtgaat
121751 gctgatgtaa aaatctgaaa taaaatatta ttaacagaat cacatactac
121801 attgagaaac taacatataa tgatcaagtg agatgattca aagaatgcaa
121851 ggatggttca atttttaaaa atatcattaa tataagttttt attaatagat
121901 ttaaggagaa aataatagaa ttttctctac agacactgaa aaattcatta
121951 cattttttca gtgtccttga tagaacaccc aaaaaggaa tgtatagata
122001 tttctctaac ataaaacatc tatagttcag acaaaatgta gatacaatta
122051 aaaaaaattg atgaatttga ttatatacaa aaagttcaca tggcaaaaca
122101 tcatagtcaa agacaaaaga caaactaggg aagtattta agtatggcag
122151 aactaatatc cttaatatat aaagaactct taaaacctaa gaaaaagacc
122201 aaaaatccta cagaaaaaca gacattaaat atgactagtc tgttcgcaaa
122251 gatacaaatt aaaatggccc ttaaacaaat gaaataatgt tcaacgtcat
122301 tcataaaaag taaaatgcaa attaaaactg agatactgtt tctcacctat
122351 cagatgagca aaaattttaa atgtgacaac acactctatt ggcaaggata
122401 ctgagaaagt cactttcact tttgaatgca tactgcatac actacataat
122451 agataaagga gtcgaaaaat gtcatttaaa actatcaaaa cagtaaaaaa
122501 gaaaagatat aagaataagg gcaaccacaa taaaggcaac cactagaaca
122551 agaatacaaa ccttcccaga taccaaggca aaatggcaca acccttacag
122601 cagggaattt ggcagtatgc aacgaaatta caaatgcatt tactctttga
122651 cccagcaatc ctgcttctaa gaatataccc tgaagatata cctccaataa
122701 tatgaaaaca cacaatagtc attggtataa tactttttaca tttgcaaaat
122751 tcaggaaatg gcctaaatgc ctatccataa tagtgtgttt aaataaactg
122801 tgtccacaaa acagaatcct gtgcaaaaca acatgatgcc ttaagatgtt
122851 tctccattac atggtcacta ctattagcag aaaactattt ttttttctaa
122901 ctaatataat aatgaaattg tagactgagc tcaactaatg gttttcagtg
122951 gggtctccat gacaatatct caaaggctgg gagaagataa gctacagctg
123001 ggtgttaggc accctgaaac tgcaaatact tgtagtctct aattttttat
123051 ttttagagat gaggtcccag tatgttgcct aggctgggct tgaactcctg
123101 ggctcaagcg atttttcttgc ctttgatcta tattagcctt tgagctatca
123151 acctaaaaaa aaaatttgac catttattct ctggctcctt atctactaca
123201 taaaagggt atgtagttct ttagacaaga ctatatgatc tagaacctat
123251 taaatctctg ccttattttt tccccactat ttgttccaca ttttatgctt
123301 ctatcacact ttaattttat ttaattattt ttttttaaca cagcatctcg
123351 ctctgttgcc cacgtgggag tgcagtggcg tgatctcggt tcattgcaac
123401 ctccacctcc ccgactcaag cgattctcct gccccagcct cccaagtagc
123451 tgggattaca ggcacgcatc atgatgccca gctaatttt gtattttag
123501 tagagacggg gttttgctat gttggccagg ctggtctcaa ctcctgacct
123551 caagtgatcc actgtcctca gccttccaaa gtgctaggat tacaaatatg
123601 agccaccgtg cccagccatc atcatactac ttttaaaaac tcctttgttg
123651 gttcttcttc ccttgctgcc attcctgaaa cgccaggaat tcctaagtta
123701 cattttagc cctccttccg aaatacagcc tcctccaggt gatctcattc
123751 aatgcccagg ttttcatcaa tcccttaaat actgacgaat ccaaaatctg
123801 tattgtcttt tgcttttgga aaataccgcc actgaggaac aacaagttcc
123851 aagttctact cactttattt cctaacactc aaagttttt ctcccttaac
123901 gattcctatt attgcaattt agtaatagtc catgccttca tcaacttccc
123951 taaacctatt atgatagcaa aatacatcta cctacagtca aactttccct
124001 acttcaaacc ttccatattt gtgttatttg tctgttacag ataattttat
124051 ctgtataaaa caaatatcat ttctcgattt aaaaaatcta caatgactct
124101 gcagtcatta caagataaac ttaaaactct taatataga atcaaaaact
124151 catataaaaa attagcaggg agtggtggca tgcactgtaa tcccagctac
124201 tggagaggct gaggcaggag aattccttca actcgggagg cggaggttgc
124251 agtgagccta gatcgcgcca ctgcactcca gctgggtga cagagcaaga
124301 ctccatctcg gaaaaaaag aaaaaaaaa aaaaagaat caaagactct
124351 gcaaattaac tccttagcga acgtattagg ttattatcta catgtattct
124401 cttaaacctc catgtattct tgagttctta atatcttccc ccgtgttctt
124451 gaaatgactt tctctcaacc tgtgaaaatc ctattcatcc tagttatatg
124501 acatgagaca aattacttaa gtacctctgc ttcttttaca acgtttgtag
124551 atgatggaga taatgagagt accaatctca caagaatttt gtaagaatta
```

FIG. 7 CONT'D

```
124601 aatgggttaa catagcaaaa gtgcttaaaa cagtgcctgg cagattttaa
124651 actcaataaa tggtaactat gaacactata atctttgact ctgtccccac
124701 ttctgtctcc ttataatgct cgtctcaaat gttactttgt caacgaagct
124751 ttctgcttcg ctagcaaaat tatctgtgct tccataataa agcactttgg
124801 tcactgctct atcttacctt ttttcttgtt ggctttcata ccatgtttta
124851 tgtttatgtg cttatggtat gattttttt ttcactgtga gcctatggat
124901 tatactgaat atgtgatcat ggtatgaaaa agcacaggcc ttggacctgg
124951 cttcagttct caggtatggc tctcattcat tgcatgacct tagaaagatt
125001 atttaacttt accgagtttc aatctctgta tttgtaaaat agaagaataa
125051 aacttatctt acaaggatac tggtaagata aaggagtct acagagagat
125101 ccagcacagc aatttcttga cataagttct ttcctttaa ctcttttac
125151 atctttaatg ttaaggtctt agaaggcatg gtctcttat gtcttatcac
125201 tgagtgtaca attcatggca caattctggc tttaagtgga ataatttgtg
125251 agtgtttgct aaacttgact aatatacctg taactacagt acactgccac
125301 tttaataccc cagctttcac ataaacacaa ccaacagatg gtgaaagctt
125351 ttatttgcct ataattaatt ctataatgtt ctgggggaaa gtcctgaggc
125401 aaacagcaga tattttgctt attcccttt taatctttgc tgtcagaaag
125451 cttacaacta aacttacctt tcaacagcaa caactaaact tctgtataaa
125501 ttttactttt tccttacag atattatctt atatgtcttt tgttaagtca
125551 ctttatatcc attttggaaa taagacggca tataaacatg ttttacttca
125601 ttttaatgac attttaggct gtgtcaaaca cgaagtgact ttagctacct
125651 ttaaaagatt ccatcctgag agcttaaaat ctgcaaatga gctagagtaa
125701 tgtgatacaa ttttttata caaattatat tgccttgtga gaaaggtaag
125751 caaagatgta tttctttgtc ccaatgataa attacacaca attcacaatt
125801 ctgccacaca tatacacata tgtatgtaca tgttatgtgt atgtagataa
125851 agattacaaa aacacaaata tacaacaaat cagaaagaga tgttagttag
125901 aataaaagaa actggatcaa cactagtcac cgaaatttat ccactgtttt
125951 actccatgga aaagtaacaa tttaccttac tgcatttagg agaattttca
126001 gattgcctag atagtatcaa acttgccaga acgttgacag taaatgcttc
126051 actaaatctg aatataatga aaaaaaatca cctaaaaatg ccttgcattt
126101 aaaactatat attcttctat actatatcta aaaagactgt agcataaaaa
126151 ggcagcatgg ttttgtgaca agtacccaag acctgttatg agaagacttt
126201 aatttgaata ttgactctga cccttactag ctcttccact ttagataagt
126251 catttaatct ctctctgaga gtccgtttct tcttattcta taaaatgggg
126301 ggaataaatat ctagcctatc tgttgtaaga accagtgaga ttttttttaa
126351 aaagtaaggt gtttcatgag gttttaccgc tttacaaata ttaaggttta
126401 aaaacactac ttaataatga cagaaataaa ctacatatgc agtaatttct
126451 caaaagtgag cattttgct gtctggctgt tactgcttac agatttaagc
126501 tataaaccta atttaagctt aatcctattt ctgaaaactg taaatacgtt
126551 gtagaaactt gacaagttga taaatgtat gctgacactt acataaaaac
126601 cctttctgtc ccatcaagag caaaatccca catttaagct gcttcttaac
126651 ttacgtttat atctgtatgg tatatgagga cacataaagc tggcaaaatc
126701 tgaggaaaga aaataaacaa tacttaacat tagttaatta atatgtctgt
126751 aaaaatgaac aactttgaca taaaagcgg taaatatggt ttgtagggcg
126801 agaaagacaa tgttaaattt gtctgaatat cttttaggaa aatgaaaacc
126851 tgataaaattc aatctaaaaa aaccaaaaac atatctcaaa tgttaaactg
126901 aaatatgttc aattaacaag ttaaaatatc caaataaatc tggcagaagt
126951 taatgtacct taaaataaaa acatttgttt ttaataacct tctttatggc
127001 ataaaatgtc aagtggaaaa aatggagatg caaatataca gttacagcta
127051 tttaagaaaa gctacactta aaactgccgt aattgtctca cttacctgct
127101 taacgtaaaa atacgatttt acttaataag ctacttaagt caaattaaag
127151 ttttcaactt cacctttagt caagaaaatt cgaaccagta caaagtacaa
127201 agctttgctt gttaaattca ggccccagag atctcttttt aaaatatggg
127251 agaaagggag caggggttg taggaaatca cacaaaatac ctttgcatag
127301 caacaaaaag tagcaggtac tagagaaaga tgtccattat aaagatacac
127351 agttggccaa gtgtggtggc tcatgcttgt aatcccacca ctttgggagg
127401 gtgaggtggg tggactgctt gatgccagga gttcaagacc agctggccaa
127451 catggtgaaa acccattct actaaaaata caaaaattag cctggcatgg
```

FIG. 7 CONT'D

```
127501  tggcacatgc ctgagacatg agaatcgctt gaaccccgga tgtggaggct
127551  gcagtgggca aagattgtgc cactgcactc cagcctggga aacagagcga
127601  gactgtctca aaaaaaaaaa aaaaaaaaag agataacaca gtcaacagtg
127651  aataaaggtt atgtaggatt ttttttttaaa atgcaaagca caaggatcta
127701  tttacatatc aaatgtaaat aaaaaagttt ttactttgtt ttaattagta
127751  gatttaacaa aaaatatgtc acacttttaa gaactccaat tttgtcagta
127801  ataaattgga gttaggccgt ggggcagtg gctcacacct gtaatcccag
127851  cactttggga tactgaggtg agcagatcac ttcaggtcag gagtttgaga
127901  ccagcctggc ctacacagtg aaaccccatc tctactaaaa atacaaaaac
127951  tagccgggtg tggtggcgct ggcctgtaat cccagctact caggaggctg
128001  aggcacgaga ctcgcttgaa cccaggaggc agaggctgca gtgagctgag
128051  atcatgccac tgcactccag cctgggcaat agaacaagac tgtctcaaaa
128101  gaagaagaag aagaaaaaaa atcaattgga cttaaagcaa actcattcaa
128151  gaacatttgc atgtaagtat actagtttg cctgtagcaa cccccttta
128201  tagctttaaa ccaacaatgc aatacagtaa taaaactttg agattgtttt
128251  ccttttgtat ttttctctct gaatttttat attttctttt tatgcagata
128301  atcaaaaaaa taggcattag gatgaactga cattctttca ggtacagtaa
128351  gacactcaac ttttatttca taggagtaat taaatatggt acgttacttt
128401  taaaatctta cacctgtggc tgggcgtggt ggctcaggcc tgtcatccca
128451  gcactttggg aggccgaggc gggcagatca cgaggtcagg aggtcgagac
128501  catcctggct aacatggtga aaccccgtct gtactaaaaa tacaaaaaaa
128551  ttagccaggc gtggtggcgg gtgcctgtag tcccagctac tcaggaggct
128601  gaggcaggag aatggcgtga acccaggaag tggagcttgc cgtgagccaa
128651  gatcgcgcca ctgcactcca gcctgggcga cagagcaaga ctccgttatc
128701  aaacaaacaa acaaacaaaa aactcacacc tgcaatgaaa tcagtatatg
128751  tattattttg tccctgtat atgaattcct gaagtacaaa catagggaaa
128801  atataccatc tggcctttac aattcttcat ttacctcctg aactgtctcc
128851  ataggcggcg ggggatcctt attcctgcag agattgacaa tgacccatgt
128901  gacgttccga aggaaggtga tggggatgga gggactgatg aaggacagaa
128951  gaggtttgac aactcccagt gatatgacat aatctctaca ttgaggacca
129001  tcacctacag aaatgaaaat tatatttaaa aaaaacttac attcaggatg
129051  agaaagtctg aaatgtatgc aatggctcat gtgggaacac tgacgttcta
129101  tgtttcctca ccattagtca aaggcatcaa gtgttgtttc tccagatttt
129151  gatctgggga acgtaaattt aacctaccaa tgctaacagc aaactgtata
129201  tccttttcaa agagcatcat cttaagtcag tacttatgag gcaagaagag
129251  agtcaacaca cattaaattc agaggaaaca tagtatgtaa tggctatgcc
129301  aatgtaggaa aaaagttaat ttagattctt aagaggattc ctttcaaacc
129351  acttacctat aatgtttccc aaagcccata ctgcttgttc acaaacattc
129401  tgatgtggtg aacgaagaag tctcagaaaa agaggtactg catctgtaat
129451  aaagaaaaac taatatttat actagcaaca tgttgaagag tttacagatt
129501  tcagatcaaa gaaattgatc aaatacacag cctggcatat tgtagctgga
129551  agaacaaatg tggcaaatat ctttacccta aaaagaatca atttcagtat
129601  tttcccctag taatagtcaa gtaccgtaac caactggcag tatctaaagg
129651  ttgctatcat accattaact aaaagaaagc aacagcatga atccttcct
129701  ataatccatt aaaaaaaaaa aaaaaaaaa aagagttcct accccaaaca
129751  tgtaaccta aaatgtaatg ctttagtcta caaaatctca attcctgata
129801  cggggattaa ccaaagaact gattaatctc atatcaggtc tatcttatac
129851  tttaaaataa tttctcataa tccttactct ttacagaatg tatacattat
129901  acccatttcc agcataagct agatcacttt ttaaaattt caatcaactg
129951  tgcactacct cattttttt tttttgctgt atctgtgtat tacttgtatt
130001  atttacttaa aatttaaatt aattcagttt taacaacttt acggagatat
130051  aattacaata aatttacatt taagtgtgta attcaatgac atttcatatt
130101  tatacagagt tgtgaggaca tcgccacaat ctaattttat aacatttcca
130151  ggacctcaaa agaaatcttg ctgggtatg atggctcatg cctgtaatcc
130201  taacactctg ggaggccgag gcagatggat caccaggtca ggagttcaag
130251  accagcctgg ccaagatggt gaaaccctgt ctctactaaa aatataaaaa
130301  ttagccgggc gtggtggtgg gcgcctgtaa tcccagctac tttggaggct
130351  gaggcagaga actgcttgaa ccagggagac ggaggttgca gtgagccaag
```

FIG. 7 CONT'D

```
130401  atcgtgccac tgcactccag cctgggtgac agagcaagac tctgtctcaa
130451  aaaaaaaaaa tatcatactc agccgggcac agtggctcac acctataatc
130501  tcagcacttt gggaagcgag gcgggcagat cacgaggtca agaggttgag
130551  accatcctgg ccaacatagt gaaacccgt ctctactaaa aatacaaaaa
130601  ttagctggac atggtggtgt gtgcctgtag tcccagctac ttgggagggt
130651  gaggcaggag aattgcttga acccaggaga cggaagttgc agtgagctga
130701  gatcacgcca ctgcactcca gcctggcgac agagcgagac tccgtcttaa
130751  aaaaaaaaaa aaaagaaaag aaaaaagaaa aagaaatct catacttaag
130801  gcagtcattc cacatttgtt cctctgccac acattcccca agcggcaggc
130851  aaccattaaa tatctgcttt ctgtctttac agatttgcct attctggaca
130901  tttcatacaa atgaaatcat actgtgtttt ttgggggggtc tgacttcact
130951  taacattctt caggttcatc catgtggtaa caggtattgg tacttcattc
131001  tttttactg ctgaattgta ttccattgta tacaccacat tcactttatc
131051  cactcctcgg ttaatgaaca tttgggttag ttatgaataa cattgctgtg
131101  aatatttatg tacaagtgtt tgtatgaata tgttttcata tctcttggtt
131151  tcacctagga gtagaactgc tgggtcacat gataactttt tttttttttt
131201  tgaggtggag tctcgctttg tcacccaggc tggagtgcag cggcacgatc
131251  tcggctcact gcaagctccg cctcccgggt tcacgccatt ctcccgcctc
131301  agcctcccaa gcagctggga ctacaggcgc ccgccaccat gcccggctaa
131351  ttttgttttt gtatttttag tagagacagg gtttcaccat gttagcaagg
131401  atggtcttga tctcctgacc tcgtgatcca cccgcctcgg cctcccaaag
131451  tgctgggatt acaggcttga gccactgcac ccagcctttg tttttgagat
131501  agggtctcac tctgtcgccg gggctggaat gcagtgtgca gtctcggctc
131551  actgcaacct ctgcctccct ggctcaagcg atcctctcgc ctctgtctcc
131601  tgagtaggtg cgactatagg catgcgccac catgcaatgc taattttaa
131651  atattttgta gagacacgat tttgtcatgt cacctaggct gttcttgaac
131701  tcctgaactc aagtgatctg cttgccttag cctcccaaag tgctgggatt
131751  agaggcatga gccacctgtg ggtctggtga gaatagtatt ctcaatacat
131801  gattcaatgt aacttactgc catatcacat gctacttaaa atcaccttga
131851  ttaccacacc taaaattagc taagtgtccc atactataat aacgtacgtg
131901  gtgatatcta gtactttct aaagagcttg tgtcagtgtc atttaacaat
131951  aattattagc ccatcttgag gaaagtaaaa tttaaaatat gtcataagct
132001  aaaaggcaga agccattcag catcttgaag atatcagaaa cggaatttaa
132051  aatcctgtta tcacagcatg atgtctactc caaaagataa aactctactc
132101  ttcttttaat aaccacaatt aaaaattttt catgataaat taatgacggc
132151  tatgaaaaag atatcggtca tcaaaagtaa cttataaaag tcatcattta
132201  aaaaatgtta caagataaaa tttctttatt acaaaactct acttccttgc
132251  catcattaaa acacaaaaag ttcagacagt aaggaattta cttactagac
132301  tgcacaacag cttgagtctg tgcagaagtt cctgatgcta tgttagttaa
132351  tgcccaagca gcttcaaact gtaatgaagg actgtaaaaa aacaataaca
132401  catctttta gacacataac taccacttaa ttaatgaatc ttaagactga
132451  taagatatgg ctattctttg ccttgtcctt gaatttcacc ttgttataat
132501  ccaattgcct gctagccaac cctactttt tttttttttt gagatggagt
132551  ctccctccat cacccaggcg ggagtgcagt ggcgccatct tgactcattg
132601  caatctctgc ctctggggtt caagtgattc tcgtctccac ctcccaagta
132651  gctgggatta caggtgcaca tcaccacacc tggctcattt ttgtactttt
132701  agtagagata gggtttcact atgttggcca ggctggtcct gaacccctga
132751  cttcaggtga tctgcccacc tcggcttccc aaagtgctgg gattataggc
132801  atgagccact gcacccagca gccatctcta cttaaaaaat ctctttggct
132851  cccaaagcca gtcactatga acctgcttct ttatgtccac tggtattaca
132901  acatttagcc agtcattatt tcccttgact tcgacttcct ctccacagac
132951  acatctaatc aatatatcat gtcgatttta cctcttaaac atttcttaca
133001  tttatataat caccctaat atcaagtgct agttgaggcc ctcatcatct
133051  cactttaacc actatcacac gctctaggct ggtcttaaag ctagaaccc
133101  atctgtctcc attacaccat ctgctttaca tactagggat attacaaggc
133151  tgtataattt tgttgaaaaa acaagatcat tatattttcg aatagtaatg
133201  gaagacctca caaagaaagt gacaactgaa ctagcttttc aaagatggat
133251  ttaaaaagaa aggcagtgac agtgggaaat aaaacaggta tcatgcatgg
```

FIG. 7 CONT'D

```
133301 aaggatcatg atgtgtagga acgacaagga ttagatcaag agagctgaaa
133351 ctaactaaga agcaagtaac agggtgtttg tgcatgtgtg tgtgtgtttc
133401 aggatgggag tgaggagtgt attctacaga tatgctaagg atggggcatt
133451 gaaaaaggga ggaaagaaaa taatgttcaa atcaatggta tgcagaatgg
133501 ctaaaaaagg ttaaaggctg atataggaga gacctattaa aagacatgtt
133551 ggggcttaca cctgtagtcc cagcactttg ggaggctgag gcaggcagat
133601 cgcttgagcc aaaaagttcg aaaccagcct gggcaacacg gtgagacccc
133651 atttttacaa aaaataaaaa aatcagccag atgtggtggt acacacctgt
133701 agtcccagct acttgggatg ctgggcgggg gtgggatggg gggattgctt
133751 gagcctagga gtttgaggat tcaatgagct gtgattgtgt cactgcactc
133801 cagcctgggt gacagagtga aaccctgtca caaaaaagac ataaaggaaa
133851 gacctgttaa aaggaaatga tagatattaa gttaggatag ctgaaagagt
133901 acaaattccc ttaagtggaa taccaaggat tgggggggatt tagtcagcaa
133951 aaattaagat tagacaaagg ttagggagtt tgaagaaaag cctataaaca
134001 gggaagagag caagcaaggt tgttagtatc aaaaggttaa agaagtccgg
134051 gcaaggtggt tcacacctgt aaccccagca ctttgggagg ccaaggcaga
134101 tggatcacct gaggtcggga gtttgaaacc agcctggcca acatggcaaa
134151 accccctctc tactaaaaat acaaaaatta gctggacatg atggtgcgtg
134201 cctataatcc cagctgctcg ggaggctgag gcaggagaat cccttgaacc
134251 caggaggcgg aggttgtggt gagctgagat tgcaccactg cactccagcc
134301 tgggcgacag agagagattc catctcaaaa aaaaaaaaaa aagaaagaaa
134351 aaagagaaaa aaggttgaag agatccaaga acaaaaggtt ttaaggagaa
134401 tagatgtcag agatatagca aatagtgata tacaggttaa aaagatggaa
134451 catatgagaa aatgaagtag cagagaagaa ctatgagggg actttaaaaa
134501 actcattaaa aatgtgtatt atgaaaaaaa ctccatggat ttcaattttt
134551 ttgcaccaaa ataaactcat actaactttc tatacacgtc tgaacatgat
134601 ctagtttgag gcactaagag gggtaagggg taagtcatca atctgaaaag
134651 agccctaga agagcaacat gaatcctgct aaaattaaag caaaaacaaa
134701 catcaaattt atggtgaagc ttgggtgaaa taatggtgaa ctcactgatg
134751 tacttaaaac tttacgggga aaatgccccc aaagaaatca gcggtttaca
134801 aatggttaac tccttttaag aagggacaag tcggccgggc atggtggctc
134851 acgcctgtaa tcccagcact ttaggaggct gaggcaggcg gatcacgagg
134901 taaggagatc gagaccatcc tggctaacac ggtgaaaccc catctctatt
134951 aaaaatacaa aaagtcagcc gggcgtggtg gcaggcacct gtagacccag
135001 ctactcggga ggctgaggca ggagaatggt gtgaacccag gaggcggagc
135051 ttgcagtgag ctgatatcgt gccactgcac tccagcctgg gcgacagagc
135101 gagactctgt ctcaaaaaaa aaaaaaaaaa ggacaagtcg atgttgaaga
135151 tgaaatccac agcggcaaac aatcaacaac aatatctgag gaaaagatta
135201 atcttggtcg tgccctaaca gaagatgatt gctgattaac agcagaaaca
135251 ataaccaata ccagacatct tgattggttc agcttacaaa attatgactg
135301 aaaaattaaa gttgagcaaa cttcccctt gataggtgtc aaaaccattg
135351 tgcccagata agccgtagac aacagcagag cttccaatga aaattttaaa
135401 ccagagggat caagatcctg aagtatttct tcaaggaatt gtaaaaggag
135451 atgaaacatg gctttcccag tatgatccta aagacaaagt acaatcgaag
135501 caaaagtgga ctggtcagga ggaaaggtaa tgactaaaaa gttttggggg
135551 atgctcaagg tattattctt gttgaccttc tagagggcca aagaatgata
135601 acacctgctt attatgagag tgttttgaga aagtcagcca aagctttagc
135651 agaaaaaagc ctgagagagc tttaccagag agtctttctc caccacaatg
135701 tttctgttca ttctgctcat caaacaagag caattttgca agagaatcaa
135751 taggaaatca ttaggtatcc accttacagt tctgatttgg ccatcttgtg
135801 acttcttttt gtttcctaat cttaaaaaaa caacctgtaa agggcatcta
135851 gttttcttca gttaatatca tgaaaaagac tgcgctgaca tggttaaatt
135901 cccaggaccc tcagttcttt agggatagac aatggctggt agtatcactt
135951 acaaaagtgt cttgaccttg atggagctta tgttgagaaa tcaagtttat
136001 atatttatta tctttcatat attttattgt cttttgattc cacttttcca
136051 caaactttta aaatttcccc tgtatatgat gaattctagc agaaggcagg
136101 aaataagatg gtatatcaga ggcagggaag aagtaaaaaa aacagtaaga
136151 tcaaaaacag taagacagta tatgttgcct cagactggaa ggagaaagtt
```

FIG. 7 CONT'D

```
136201 attaagctgg ttaggtggtt tggcaaaata ctgggaatgg gggacttaaa
136251 tgagaaaatg gataaatgta aaaataaaa ttataaagcc aaagaaagtc
136301 tttcaagatg tcatgtggaa aaataaaaaa aaatgagaaa agatatagaa
136351 aaaacgagtg caataacaaa tggacattta tggccgagtg cggtggctca
136401 cgcctgtaat cccagcactt tgagaggccg aggtgggtgg atcacaaggt
136451 caggagatcg agaccatcct gtgaatggtg aaacccatc tctactagaa
136501 ataaaaaaat tagctgggcg tggtggcagg cgcctgtagc cccagctact
136551 cgggaggctg aggcaggaga atggcgtgaa cccaggaagc ggagcttgca
136601 gtgagccaag attgtgccac tgcactccag cctgggcaac agagcgagac
136651 tcggtctcaa aaaataaat aataaaaat aaaaataaa tggacattta
136701 tcataagttt gacattgtgt agagtgcttt gtatgtatta tttccattcc
136751 ttaccatcac ctaattttta tagatgagat agctgaggtt caaaagccac
136801 gtggattttt atcaacagca aaccctggat ttgaaccaca gtcaatctgg
136851 ctccaaagta tatggccttt tacattataa cacaacttcc catgacaaat
136901 ccataaagtc agatccaaat cacggaaaat tttctgtttt tgctttgggt
136951 ggtggttaca gaggtctgag tttcataatt attcattaag ctgtatatat
137001 tttagcatat ttttctgtat tatatgttat gtttcataga cacagacaca
137051 caaatgagtc tacatataaa agactggaaa gaaaaggaaa aaagaagaa
137101 gagaagttgg ccacaaacaa ggggccctag gccgggccca gtggctcatg
137151 cctgtaatgt ctgcactttg ggaggctaag gcaggaggat cacctgatgt
137201 caagagttca agaccagcct ggccaacatg gtgaaacccc atctatacta
137251 aaaatacaaa aattagccac acctgtaatc ccagctactc aaagaggctg
137301 aggcatgaga atcgcttgaa cccgggaggc agacattgca gtgagccaag
137351 attgcaccac tgcactctac cctgggcaac agagcgagac tctgtctcaa
137401 aaaaaaaaaa aaaaaaaaaa aaaaaaaaaa aaaagaacaa ctggagggtc
137451 ctaaaggtag aagtagaata gaacttattt attatttat tttattttat
137501 ttttattatt attatacttt aagttttagg gtacatgtgc acaatgtgca
137551 ggttagttac atatgtatac atgtgccatg ctggtgtgct gcacccatta
137601 actcgtcatt cagcattagg tatatctcct aatgctatcc ctccccctc
137651 ccccctattt attcatttat tttgagacgg agtcttgctc tgtcgcccag
137701 gctggagtgc agtggtgcga tctcggctca ccgcaacctc cgcctcccag
137751 gttcacacca ttctcctgcc tcagcctccc aagtagctgg gactacatgc
137801 gcctgccacc acgcccggct gattttttt aatatttttt aatagagaca
137851 gggtttcacc acgttagcca ggatggtctc gatctcctga cctcatgacc
137901 cacctgcctc agcctcccaa agtgctgaga ctacaggtgt gagccactgc
137951 acccagccga atttattttt tgagtcaggg tcttgctctg ttacccaggc
138001 tggagtgcaa tggcatgata ttggctcagg acaacctcca cattccaggc
138051 tcaaacgatc ctcctacctc agcctcccaa gtagctggga ctataggcat
138101 gtgccaccat gcctggctaa ttttcgtgtt ttttttttt tttttttgt
138151 agagctggga tgttaccatg ttgcccaggc tgctctcgaa ctcctggact
138201 caagcgatcc acctacctcg gcctcccaaa gtgctgggat tacaggcgtg
138251 agccactgcg tccagccaga atttattttt tcaacagcta aaataaaact
138301 tacctttact taagtaacac tgttacagaa aacaaacatg atagtatttt
138351 aaaaagtgtt acaggcctgg gggtggaaag tgggagaggt tgtggcacac
138401 aacgaaagca aatggtattt ttaaatacta aaaacccttaa gtggcaacat
138451 ttatatacca ctattcttat ctagccaact gaaaattcct tggacaacat
138501 ttagcaaaat atcccaagtt tcagtctaga tgctcttaaa tgcaaaaaaa
138551 aagcatttgt tttaatatgt tttggagttc aaacttatat tctccccagt
138601 taatccaaat taacaaagtt taaggcacag cactgagata tcactaaaca
138651 aaaatggaaa tagggccagt tcctcaaaag atatccagtg gagttttact
138701 ccttctctcc tgggtaaata taacctgtcc ccttattctt aatttgcagc
138751 aaacaaaaag tctgacattg gacaacttat catggatgaa gttctgttaa
138801 agacaacaca gaggatcagt aatcagctgg aagattccca gggtaagaaa
138851 gagccactta gttctggaaa ccatccatgt tgacttagtc atgaggttaa
138901 tctatatata ggctcataag caaagagtga ctcaaacatt atttgggttg
138951 ttttaaaata ttagtaataa aaatcctaa taaagactat aaatatttga
139001 gataagttaa aacaggcaat aaacaggaga taaaaattttc ctagaaaaca
139051 tacacatcct tcagaaatga aaacgagaag cactctgggt ctgctaaata
```

```
139101 tgatcacaga ataagaaaat taaattaaaa tatatgacga ttgaaaaaca
139151 tcataagtac aaaaccaaac tgaactcact ggttaagtaa taatccaaac
139201 ttttaagtta actgaaaaaa actgaatagg gagtaaaatc catacttact
139251 tatcatccct ttctagacat ttgactagaa ttggtaaaat cccagatttt
139301 attaagtcat caatcggtgg atttctgtca ctggataaca gttttctagg
139351 aaaataaata tgagaaatta attgctataa ttttcaaact gtgaaaagaa
139401 ataacaacat attaacttct agactaccag gtaacacaac tgaggaatga
139451 cataattctc tctctagaca aattagtatt taccttgctg cctggacagc
139501 actcaattgg accactgggt tatcacttgt ggcattctgc aataccaaat
139551 gtaaatttca gaatgaaaaa aaaaaaaatc aatttcaaaa tacttcaaaa
139601 cgagagtatt aatttagtaa catacctgca atatagcttc tagggttaca
139651 ttttgcttaa aaagaaaaaa aaaatagttc agcagagttt attaacaaaa
139701 ttacattcat taaacagtgt acctgagtta atatactttc attatcatta
139751 taaagttggt cttatattaa aaatgaagtt ctcacagtta ctataaaaat
139801 tattttaaaa tcactattaa aacatggtaa cttactgctt taaaatcagc
139851 atcaacatct gaatcttcta gactttcttc ttggggaaca tttctctttt
139901 tcaataagtg ttcatctctt ttgttctgaa aggcaaccaa taaatgctta
139951 agaagtcata aggactactg ttaatgaaaa atccattaaa actacttcaa
140001 ctttattagg caattatgaa acaaatactg aacacataag gataatatga
140051 attaaatgtg catactgcaa accaatgaca agggtcacat tctggcttcg
140101 gtaacaaaat ttcctggctg gcttttacac acacacactt cattaagcac
140151 ccactgtggt gttttttttt tttttttttt ttggagacaa gagtcttgct
140201 ctgtcaccca gtctggagtg cagtggcaca atctcagctc acttccaacc
140251 tctgcttcct gggttcaggt gattctcgtg cctcaaactc ctgagtagct
140301 gggattacag tcgtgcgcca ccacacctgg ctaattttta tatttttagt
140351 agagatgtgt ttttgccgtg ttggccaggc tgatctcaaa ctcctggcct
140401 caagtgatcc gcttgccgcg gcctcccaaa gtgctgggat tacaagcgtg
140451 agccactgcg ccttgcctat ttgcgtaagt ttgctcatac ttaaattgta
140501 gattgtttgc aaaaatggca gtaattcccc ttcccatatc cagtcccgca
140551 ctgactgtag gcatggctgt gtgacttgct ttggcaatgg gacattaagc
140601 aaacagactt gaaaagtgct tacacatcag ggacaggttc tcttttgcaa
140651 cttttttcct gaaatcacct tgtgaacact gagccatgga gaataagact
140701 gtgtggacaa caaacaagtc ccagccaagt tacctgagac catgttagat
140751 catctagtca ccaaccaacc ctgtcagctg accagagaca gtaagggaag
140801 cctgcagaaa acagttgaac tggcctgtgc cagaaaaccc actctgccaa
140851 cccacaaaat tgttagctca ataaaatggc tattgtttta agctacatag
140901 tttggagtgg tgtattatga agcaaaaaac tagatgatgc actcatgttt
140951 ttaaatttat gctgtattta aattaataag acttctaaaa ttcctggtat
141001 tttgttgttg ttccttctct ctacttgcta taaatttgtc tcctgaatta
141051 ccactttaac tgtattctac aggttctgac atataatagt tttcctactg
141101 ttcattttta ggtattccta gaatccatta agatttcttt tatactcaat
141151 atattcaata tattcagaca tactttaaaa cgttcacaac tatgaggttt
141201 ttgtaactgt cttattcagt gatttctaat ttaattacat tgaagtcaga
141251 gaacatgtat gtacaataca ctgaaattag ctgacatctg ctttatacca
141301 gaagttccca aactttctca gtccacagtg tacgccaaag tagtcatttg
141351 ggaaaagaa aagaaaaaca aataaactaa aagaaaaaat tatttcactc
141401 ttagataaaa taattgtaga aaggaatgta gtgttattta agtgtttaaa
141451 ctgtggacta cctcgagatc taatagttct gtggtgtctg aaagatgtca
141501 ctgtatttct ctcaaaactg aaatatccca aagacccttt caggtcactg
141551 tggagcccca tgttacctca gcgcagagtt tggaaactac atcttattct
141601 atcataaaac cagtttccaa acacatatgt ggttttacat gtgtctatta
141651 gttaaaattt gtgaattaaa ttattcaaat tttctatctc ttcttgtgtt
141701 tattcattac taagaaaatc tcccacaatg attatatctt tgatgaattt
141751 ccccttctaa ttttgcaaat tttgacttta tatatatata tatacacaca
141801 catatatata tatatataga gagagagata gatagagaga gagagagaga
141851 gagacattct attaggcata tactagttta gagctattat agcttctttg
141901 taaattattc cttttatcaa acattgggta acaacccctg catttaaatt
141951 gaaaacatcc taacatagac caaaatatct atggcacaag aaccatattt
```

```
142001 acttatttt tatttttag atggagtttt tgctcttgtt gcccaggctg
142051 cagtgcaatg gtgcgatctc agctcactgc aacctccacc tcccgggttc
142101 aagtgattct cctgcctcag cctcctgaat agctgggatt acaggcatgc
142151 gcctccatac ccggctaatt ttgtattttt agtagagacg gggtttctcc
142201 atgttggtca ggctggtctc gaactcctga cctcaggtga tccgcccacc
142251 tcagcctcca aaagtggtag ggttacagtc gtgagccacc gcgcccgccc
142301 catactttac tcttaacaaa aatatgtaca agccaaggaa aaataatcac
142351 tgggcaggtt tctaatggtc agattaatca ttaaaaccag taacttaaac
142401 tgtcccttca gttgatacct agagattttt accctcctga aaactgcact
142451 acaataaatt cagcatccgt aaagggtata ctttctttt gtcaggtgag
142501 aaagcagctc aggggttatg ggaacttacc taatttcaac acccaaccaa
142551 tccttaaaca cacatatgga ttaaatggat ttcttaaatt cctttaaaaa
142601 tccattatta atctattatc cacgtatgca tgtatctacc tagcccttt
142651 ggatcttctg tttttacta ggttgaacca catgaactgc tttgtaggtc
142701 aaagcagtta actatgggcg atttcttata acccaactta atatattgtt
142751 tgagttagta agttctgtat gttattaaac tctatataaa gtacttcctt
142801 ttcattccca aattcctctt tccaccttga aaaactggct tgcaattcta
142851 tacctaaact tgtggagcaa gtttgatgcc aattctttta aatcttatga
142901 aaaggataat tacattattt atcagccccc tttcaagctt gaaataagta
142951 attaaatctg tttttatcca ataataccct cactttaaat cttcatctag
143001 tttaggtttt agttccttgg gttttgtttt gtttttaag aaatagtcca
143051 accctggttg catctaaatg cttttaatga ggtaggaaaa tatactcaat
143101 gaaaattccc ctcaatatta acatttatga aatgatatta ctgctgggtg
143151 actacatgga tattcaccca caagtttat aagttatatt tatgttttgg
143201 gcactctgtt cagtgtgtta tgctttgatt aaaacaaatt ttttaaaata
143251 acactactgg ttcatgaatc atgttaagaa ctgacaatct aatgcatgtt
143301 tctttttcc ctgcaggatc atttaattca tcttatcaaa tagctgcttt
143351 tttcgatact aacttagact ttttttggta actgaaattt ttattgagat
143401 aattgtatat tcacatgcag ttataagaat atggagagat cccttgtatg
143451 ctttgcccag gttaccccaa aggtaacact ttgcaaaact atagtacagt
143501 atcacaactg ggatactgac attgatacaa tccacttatt ttattcagac
143551 ttctcgtttt acatgtattt gcatgtgtgt gtgtgtatta catcccatac
143601 aattttatca cctgtataga ttcatgttat ctaccaccac agtcaagatg
143651 gtaaacactt ccaaaaacac aagatgcatt cctccttta taagcaaaat
143701 caactccttc tcatctgaca ccgtatataa cccttggcaa ctactaacct
143751 gtcttccatt tctaaaattt tatcatttca aaatttat ataaatggga
143801 tcgtatggta tataacctt ttatgacaga attataggct cagtataatt
143851 gtctggagat ttatataaat tgttgcttgt atcaacaatt gttgcttata
143901 taattgttca tttttattgc caaatagtat ttcatcatat agatatactg
143951 tagacatatt acagtatgtc tatttaccca ttaaaggcca tctgtgttgt
144001 ttctaagttt tggctattaa aaaataaagt tgctatatag acatgcatgt
144051 acagatttca tatgaataca aatcttcctt tctctgagat caatgtccag
144101 gattgtaagc actgggttat acagaggttg catgtttaga caaaaaactg
144151 acaaactgtt ttccggagtg actgtaccat tttacatttc caccactaac
144201 atgagtgatc agtttctcca catcttcgcc agcatttggt gttgtcacta
144251 ctgtttattt tagctgttct gatagatgtg tagttgtggc tttaatctct
144301 atttccctaa tagctaacga tgctgaacat cttttcatgt gcttatttaa
144351 tatctgtatg tcctcctttc aatgaaatga ctcttcacat cttttaaat
144401 tagactgttt tgttttttct tactattaag tgtgtgtgtc tgtgtgtgtg
144451 tgtgtgtgtg tgtgtgtgtg tgtgtgtgtg tgtgtgtgtg taagagccag
144501 gggtctcact atgttgccca ggctagagtg cagtgactgt ccataggcaa
144551 catcatagca tactgcagcc tccaactccc gggctcaaga gttgttttg
144601 cctcagcctc ctgagtagct gggaatacag tgttatgcc actgcacctg
144651 gctcttactg ctgagttctg agagttcatt gtatgtgctg gatactagtc
144701 ttttactgaa tacgtggttt aacagatatt ttcttccaat atctaacttg
144751 tcttttctat cttttcatat gggctctcac acagcaaaat ttttaattta
144801 atcaggtcca atttatcaat tgtttctttt atggattagg cttcgtggc
144851 caaatatagc tctttgtctc cagatccaga aaattctcta tgttttttcc
```

144901 taaaactttt atagctttgt gctttacatt taattctata atccattttg
144951 tatttttgca taaggtgtga agtttaggct catcattttt gaaaaagctg
145001 tccttccctc cattgaattg gttttgtaac tgctaaaaat cagctggagg
145051 tatttgtgca ggtgtatttc tgggttatat tttctgttcc atggtctatg
145101 tctttccttc taccaataac acacagtatt gattactatg gctatatact
145151 ataagctttc atattgcgtg aagtaatttc ccctttttc ttgtcaagat
145201 tgttttagct attctagaga ctgtgtcttt ccatacacat ttttaaatgt
145251 ctatctatgt ccacaaaata tcttggttga atttcaatag gaaatgcatt
145301 aaaccaacag atcaatttag ggagaatcaa tgtcattatt acgttgaggc
145351 ttccaatcca agaacacagt atacatctct ccatttactt gtcttgtttc
145401 atgtctttca ccagcatttt gtaatattca ctgtataaat cctgtacatg
145451 tttgttaata tatactgaag tatttttattt tctttgaatt gtctaaaaat
145501 tgtattgttt ttaatttttgg tttctgcatg ttcagcatat ataaatgcga
145551 ctgatttctt tattctgtga ccttgctaaa ctcacctgtt agttccagga
145601 gctttctgat agattccttg ggatgttcta catagataat cacattatct
145651 gcaaatacgg acagttttag ttcttccttt acaaactaca tacctttcat
145701 ttctttttct tgccttatat ggcactggct agaacttcca gcattatact
145751 gaataagagc agttatgatg gacttcctca ccttgcttct gaatctcagg
145801 ggaaagcatt tagtctttca ccattaagtg tgatgttagc tgtgaggttt
145851 ttgtggtgct ctttaccaag atgaggcaat tcctttctat tcctttttatc
145901 agaaatgagt aactgatatg atcatatttt tcttttttgg cttattaata
145951 tgggggaatt tagagtattt ttaaaagatc tttcaaacaa ttaactaaac
146001 aagtactgga tcttatcaag caagtggggc acttgggtgg attttttctt
146051 tatgtaggat cttaaacttg cctcacctcc aaatctactg aaaataaggg
146101 cctatggcct gactgaccaa tcatcaagaa aagattaggt caaatttaat
146151 ataatgtgcc aaaagttgaa aatataagta acaggttttg ggctcattct
146201 caacccacga agcattattc aaccaacaca catgtatttt gagaggcatt
146251 atagcataat ggtaagagct ctgccattta ttagcttgtg actatgcaag
146301 ttacttaatt cctacataac tctgtctaca atgtgatgaa aaaaaagagg
146351 tacagatgtg tgtttaagtg ttgatgcata aaagcctctc taaattggga
146401 agaaagagag caaggaggta aaagaaaaaa caattcacac gaaaggagtc
146451 agaggccagg taaacagtac ctattaataa acagatgtca tctgtcatcc
146501 tcaattttga cggatcagta tctgttattt gaagtgtgat ccttacacta
146551 gttaataatt ctcaaactgt ttgttacagt tctgctacaa gataaggagc
146601 ttttaccttc agggtgataa gcctctaaag taacaaaaaa aggtggggag
146651 gtgagcttgt gccagaatgt aaaccaactg tgaaactaag cacactgttt
146701 agttcagctc tttatttaga cagaaagacc tgctttaaac atattatttt
146751 taaaagttg acaaaaattc tatatatgta ttgagtaaaa catgatgatc
146801 tgaaatatgt ataagctgtg gaataatagc tatgagttaa taaacacagc
146851 tgagtgcagt ggctcatgcc tgtaatccca gaactttggg aggctgaggc
146901 gggcagattg cttgagctca gaagttcaag accagcctgg gcaacatggc
146951 gaaatcccgt atctaccaaa aatacaaaaa attagctgag caaactggtg
147001 agcacctgtg gtctcagcta cccaggaggg taggagaatt gcttgagcct
147051 gggaggcaga agttgcagcg agccaagatt gtgccactgc actccaactt
147101 gggtgacaga atgagaccc atctcagaaa aaaaaaaaaa aattaacaca
147151 tgcattacct tacatttcat ttttgtgtgt gtggtgaaaa cacttaaaat
147201 ctactgtcag tgattttca agaatataac acattgttat taactatagt
147251 tcataaccat gtgatatggt ttggctgtat tcccacccaa atctcatctt
147301 gaattgtaac tcccacaatt cccgtgtgcc gtgggaggtg attaaattat
147351 gggggtgggt ctttcctgcg ctgttctcat gatagtgaat gagtgtcaca
147401 agatctgatg gctttaaaaa caagttgcc tgcacaagct ctcttgtctg
147451 ctgtcatatg ggatgtgcct ttcaccttct gccatgattg tgagacctcc
147501 ccagccacat ggaagtgtga gtccaataaa cctctttctt ttgtaaattg
147551 cccagtttca ggtatgtctt tatcagcaac gtgaaaactg accaatatac
147601 catgttctac agtaaggtc ttgaacttat ccctcctatc taactgaaat
147651 ttttatact ttgaatcaat atctccccaa atccctgtac cccccacccc
147701 tggccccagc ccctggtaac caccatccta catgagtcta gcttttttag
147751 actccatgca taagtgagag catgtgatac ttgccttgtt tgcctggctt

FIG. 7 CONT'D

```
147801  atttctggta atgtaatgtc ctccaagttc atccacgttg ttgcaaaaga
147851  gagggtttct ttcttttaag gctaaaaagt attccactat gtatacatac
147901  cacattttct ttttctattt gtctactggt ggacatttgg gctgattcct
147951  tatctcgggt attgtgatgc aataaacatg ggagtgcagg tatctcttca
148001  acatactggc ttcatttttc ctttggatat atacacagta gtgggattgc
148051  ttgatcacat ggtagttcta ttttaggaa cttccccata ctgctttcta
148101  taatgtctat actaatttac attctgacca agagtgtaca agagtttcct
148151  tttctccaca tcctcaccaa catgcgttat ctttcatctt tttgataatg
148201  gttattctaa caggtgtaag atgatatctc acagtagttt taattttatt
148251  tctctgatta gtaatgttga acaatttta gtatacctat tagccagttc
148301  tatgttttga gaatgtttat tctgctcttt tgccctttt ttttttttt
148351  gagatggagt cttgttctgt cacccaggct ggagtgcagt ggcgtgatct
148401  cggctcactg caaactccgc ctcccaggtt cacgccattc tcctgcctca
148451  gcctcccgag tagctgggac tacaggcaaa tgccaccacg cccagctaat
148501  ttttgtatt tttggtagag atggggtttc acccgtgtta cccaggatgg
148551  tcttgatttc ctgaccttgt gatccgcccg cctcggcctc ccaaagtgct
148601  gggattatag gcgtgagcca ccgtgcccaa tccttgccca ttttttaatt
148651  gttagttttc ttgctattga gttcattata tataacccct tatcagatgt
148701  atggtttgca atatttct ataggttctc tctttattaa tagtctcttt
148751  tgctgtgcag aaccttttaa atttgatata attgcatctg tctatttttg
148801  ttttgttggc tgtgttttg gggtcatatc caggaaaaca ttgcccagac
148851  cagtatcatg gagatttttcc cctgtgtttt cttccagtag ttttacagtt
148901  tcacatctta tgtttgcatt ttaatctatt ttgagttgat ttttgtatat
148951  ggtgtgaaat aagggcctgg tctcattcat ctgcatgtag atagccagtt
149001  tttccaagac catttattga aaagactgtc ctttcctgtg gcatgttctt
149051  ggcacctttg tcaaaaatca accaactaca aatttgtgga tttatttctg
149101  gtgaaataaa ttcttgcgtg tcagagcata tctttcaaa tattcacctt
149151  agttgcctta gacacccctt tctttttttc tgtataacat tatttccttt
149201  ccagttacta tggtcgatt tctgaaaata cttgtagtag gaccaaaaat
149251  gaaattaact aaagaaatct caagtaattt cttatttcaa atttaagcat
149301  tccccaagta agccgtagaa agcaaacttt tctgttccac tgttctgtgt
149351  gtgtgttttt atgtctctat catgctgttt tgattattat ggctttgcag
149401  tagattttca tatcaggtag tgtgatgctt ctgggttcat tctttttaaga
149451  ttgctttggc tatttggggt cttctgtggt ttcatataaa ttttagtttt
149501  ttttttttcta tttctgtgaa aaatgacatt agaggtttga tagagattgc
149551  actgaatctg tacatcactt tgggtagtac tgatatttta ataatactaa
149601  ttcttccaaa tccgtgaaca tgggatatct ttcaatttac ttctgtcaga
149651  aagactctct tgaaggaagc agtgccttct tttacatttt ggcacaagct
149701  ccctaacttg tcacagatca ggactttga gtagcacggc ctatatctga
149751  agtatttgtc ttaaaacttc aatacatgac ttaaatataa gtgcatattt
149801  ttagagatca taattaaatt taattcgtga atatcagcac ttaatcgact
149851  acatagccac aatgtgatta ggcatttga gatgggctaa gaaagagact
149901  taggagttat ttgggaggct ggggtggagg gatgtagatg gatagtgaat
149951  gtggttatta tctgcacttt agaagcttac aatctaaggg aaaatgaaat
150001  attcaaagca aaatcccatg gagtaaagtg agttacaatt gacagatgat
150051  atccactagt ttaatttctc agtgaaactc tggggactag ctctcttttg
150101  ttttcaagaa tctcaatgtc actaaataaa aacaatgtga ttctctcctc
150151  aatggagcaa tagagagagc aaggcctgga atcagggaca gatactctga
150201  ccataaagag tggaagaatc ttctcttgaa gagctctcca catctctgta
150251  aaatcacatc aaaatcaatt aagttttgtc tgaataaact tcaggcgttg
150301  tttcaggaaa agtttgcttt ctactgctta cttggggaat tcttaaactt
150351  gaaataagaa attgcttgag atttctttag ttaatttcat ttttggtcct
150401  actacaagta ttttcagaaa ttgaacctta gtaactggaa aggaaataat
150451  gttagccaaa aaaaaaaaa agaaaggggt ctctaaggca actaaggtga
150501  atatttaaaa agatatgctg tgacatgcaa gaattttag ttctataaat
150551  tagagaaggc agcacaacaa caggaggagg atcaagtaac caaatataat
150601  atataaatta gtagcttaga tttataagca cattagaagg gctaaaatga
150651  ttaaacaaga ggaggcttct gaactaatac aaaagttta aagttgaatt
```

FIG. 7 CONT'D

```
150701 gcaagcgtga aaagttaagg aaaagtaagg gcccatatct ggtggcagat
150751 ggtgtaatgt taacagatgg caataattac taattactta attccaattt
150801 tacttctatt gcatctatta aagaaagtaa tcttcatttg gtgaatgaaa
150851 atccagacaa aaaaggacgc acactattct acctatatag agttctaaat
150901 atgcaaaata atctgttaga aatcagaata atggttacct tgggggataa
150951 ccaataccta gaaagaggcc ctgggtatt ctcttttttg atccaggagc
151001 tggtggttac acaatgtgt tcacattaca aatattcatc aagctggata
151051 cttcgacgt gtggactttt tgtatgtatg gtgtatgtca acaaaatgtg
151101 aaaaagaaaa aaagtttaaa gtgttaagac tggaaaaaac accttacttt
151151 attaagctaa ggcttagctc atttctctgg tctaaatgac ccaaagatct
151201 gaaagaactt gcaaatatga ttaccaaagt attgttgtgt ccataaagga
151251 gttgacaggg aatgggaatt agcaagtatt tttatgctta tgttaatgtt
151301 tattatgcta atgtttatta atatacaaaa tgattgatga ttaatagata
151351 atagacaaaa taattctatc attagttgtt aatccattga tgattgaaac
151401 aaaaaaatga tcttccttgt taatttccta attttggagc tactggacta
151451 attacataga aaatattcta tgttgtgagt agctggaact acaggtgcgt
151501 gccaccacac ccaactaatt tttgtatttt tagtagagac agggattcac
151551 catgttggcc aggatggtct cgaactcttg acctcaggtg aatttttga
151601 aatttagtaa atatatacta caactcttag caagtatttt caaaatttac
151651 ttttaaaaag ggggcgggga aagggtacag gagaatggat gtcaggaact
151701 atatactata ccaatgagca tgacactgat ttgcaaaaat tcaaaatatg
151751 gttatttaaa cacttagaaa aaataagcta atttcaattt atccttcagg
151801 tttcagctta aatgttattt cttcagacaa gtcacctttg aatgcccaat
151851 tttaaaaaaa acctcactct gttaactttc atggctattt ttcctccata
151901 gcatcatcca caatttgtaa ggatatattt ggttatgtga ttatttatct
151951 agtgttcacc tccatgagac aattgctcaa atggtaatgc ttggttgaat
152001 aactaaatgc atttctgatg aagaccttat gaatgtagtt aaaatgagct
152051 tctggcaata ttgttgtaaa actacagatt tgaagagcta cctagccgt
152101 gtatgaaaca aagtgtgtat ttaaaataat tcttaaataa taaatgcaca
152151 agtctatttc tagtgactct aagaaaatgt gtactttcag aatcaagacc
152201 tccttccttc tccctacaac tgaaaagttt caagacggta atttttttt
152251 tttttgaga cagagtctcg ctctgtcacc taggctggag tgtagtggcg
152301 tgaccctggc tcactgcagc ccctgcctcc agggttcaag caattctcca
152351 gcctcagcct cccgagtagc tggaactaca ggtgtgtgcc accacaccca
152401 actaattttt gtattttag tagacagggt ttcaccatgt tggccaggct
152451 ggtctcgaac tcttgacctc aggtgatctg tccaccttgg cctcccaaag
152501 tgctggaatg acggcatgag ccaccgcacc cagcccaaga tggtaattca
152551 atataggaag gagttttagg agtgaattac atgaggaaaa gtctaaccta
152601 agacaaacac caaagatctg aaataagttt taaatttatt ttttaaaaga
152651 tatatgtata ggccgggcac ggtggctcac gcctgtaatc ccagcacttt
152701 gggaggctga ggcggcaga tcacgaggtc aggagatcga accatcctg
152751 gctaacacgg tgaaacccca tctctactaa aaatacaaaa aattaaccgg
152801 acgaggtggt gcatgcctgt agtcccagct acttgggagg ctgaggcaga
152851 agaatggcat gaacccggga ggcggaggtt gcagtgagtc gagatcacag
152901 tactgcactc cagcttgggc gacagagcga gactctgcat cagaaaaaaa
152951 aaaaaaaaaa aaagaaacgt gtaaagaaag agaattcact attattttct
153001 ggattagcaa tttaaatatt tgtttcaaat aaaatgtgtt cacatgaaaa
153051 cacaatttgg gccaggcatg gcagctcacg cccgtaatcc aacagaagg
153101 acgattgttt gagtccagga attcaaggcc agcctgggca acatagtgag
153151 acctagtctc tacaaaaaat aaacaaaaat tagctgggtg tggtggtgtg
153201 cctgtattca cagctgggtg tggtggtgtg cctgcattca tagctactca
153251 gccagctgag gtgggaggat cacttgagcc cgggaggtca aggctgcagt
153301 gagccaagat cacaccactt cactccaacc tggacagagt gaaacgctgt
153351 ctcaaaaaaa gaaagagaaa aagaaaaca caatctgatg aaggtaactc
153401 taaaatcctc caaaaataat ggaagaaaat acaataaatt ttaatagcag
153451 ttgctttcag ttgggaaaac acaaggtttt tctactttc tactttatt
153501 tacttctgta aagtatcttc aacaaggatg tgtaacttt acataagcaa
153551 agggagagga agcccacaga aagaggatgt caaagaaaat gtatctaact
```

FIG. 7 CONT'D

```
153601 tcatcagatg ttatgagaat ttcagtgatg gtaaagtgct tcacacaggg
153651 cctagtaccc tcagtaaatg aaagctatta tgaataagta ccatgataaa
153701 gtatccagtg atgtgtggtt ttagggatga ccactaattt gccacagtat
153751 tttcattatt caagatacac agaattttaa catcagaaaa atctaattac
153801 ttttctttaa atgtaaatca accttacctt ccgcagttcc actgtcactt
153851 catttctatg tcttcgcatt gtctagaaaa gaaaaacaaa gattacagat
153901 gtatcaaaat acggacactg ctagtatata aagatctcag ctgggtgcag
153951 tggctcatgc ctataatcct agcactttgg gaggccgagg cgggcagatc
154001 acttgaggtc aggagttcaa accagcttg gccaacatgg cgaaacctag
154051 tctctactaa aaatacaaaa aaaattagcc gggcttggtg gcaggcacct
154101 gtaatctcag ctacatggga gactgaggca ggagaactgc ttgaacccgg
154151 gaggcggggg gatgcagcaa gccgaggtgg cgccagtgca ctccaggcct
154201 gggcgacaga gcgagactgc atctcaaaaa aagaagaag aagaaaaaaa
154251 aaaactcagg tatttgagtt agaagtcatt taatattggc tgggtgcagt
154301 ggctcacacc tgtaatccca gcactttaga aggctggagg atcacttggg
154351 gccaggagtt cgagatcagc ctggccaaca tggcaaaacc ccatctctac
154401 taaaaatacc aaaattagct gggtgcagta gcacgcccct gtactcccag
154451 ctactcctgg aggctgacgc tcaagaatcg cttgaacctg ggagacggag
154501 gttgaagtga gctgagatca tgccactgca ctttagcttg agtgacagag
154551 cgagactctg tctcaaaaaa taaataaata agaagaaatt tataatctca
154601 atgactgata catcttatac tttaaatgat gagctacaat tagttaaaaa
154651 gccaaattct gtatttactg gatatctgtt ggttaatttt gtggaaggtg
154701 ggacttggct gcctaggacc catttccctg ccctaactgt acccagtcat
154751 ctttggggaa ttcatccctt cccatcctgt agtcttaatg agacctaaag
154801 tggctcactc tctcctagct taagtaggtc acaagactca actacactat
154851 cagaattatc tcctctataa ctctgaatct taaggagaaa gggaaaaaaa
154901 ggcacattaa attccaaagg aagaattttg gacaaggtag taaataatgc
154951 ctatatcctt gacttgctca attcccagtt cttccatttc tctactcatc
155001 ttatgaacta ccttacattc ttccaataaa ttatggtttt gcttaagtca
155051 gccagggatg gtttctgatg tctgcaatca atgaattata tctctaatga
155101 ttcatatttt taaaagtaa attcattgcc atggccttaa aaacatgaaa
155151 ataaaaataa gtttgagata gatgtttgt atcaaaaggt aaggtatcct
155201 tctgagttta agaggatcta tcaggcatgc cttatgggga aacactgaaa
155251 taatatatat ctcccctcta acatactgat ataatggatt cttttattac
155301 acatataagc atggttacat ctttatatta ttggaataaa ggctatatga
155351 tcatggtata ttattatttt aatatactgc caaggttcag tgtgctatat
155401 tttatttaat aattcttgtg atatctcttt cttaaaccac agtgatcttc
155451 ttaagaaaaa aaatctcata aaatccaaat tataaagttt gctaactata
155501 ctgaaataat ctagatataa acttaaactt aaatacagat atatattaaa
155551 tagaaacaaa actgccaaac aaaattcaaa ttagtcatat tcatttcatg
155601 tgatggaatt atatactgat aaaaactatt atccctgata aggttcgaca
155651 ctagaaagaa ccttgaattt aattctatat ttagtatgtt tctatattgt
155701 gactttagta ctattaatac agagaatgtc ttacgcataa gttcataaaa
155751 atgacaaatg ttgaacaatc ttcaaatacc aacattaatg aagtgttatt
155801 tgacaactct ataagctatc tttattcact ggaagattag aactctacca
155851 ctgttaaaaa ttttacctaa atgaatattt acttcaattt ttcctataac
155901 tgaaagaaa aatattttca ttgcaatatt tgcaacactt aactatttat
155951 gaattattaa aagatgatgc ataacaaaaa gatccaggca gcatatctgc
156001 tccaaaatat gattttctgc tctatcatct taattcacac taagatattt
156051 ctgtatagac agaattagtg agttaaattc tgaagaacca cactaaatta
156101 ggaaaccaca cttaagaggt gattaattta atgttttaaa caccctaaaa
156151 caggagttag ctcccaggta gtaagtgctt cgaatatgaa catctcaatt
156201 tatagacact ggtttgatac tctgcataag gaaagttgga aatagatttt
156251 tactgctaaa gtagaacagt tattcaagat atacgaattg actagaaata
156301 caggcacctc gattcttact tgtttggggt ctaagaatcc ggcaggccct
156351 acagcacaac ttcagagaag tttctgtgtc tagaaacccc cttgatcctg
156401 tgttccatcc cttcttagag aactgtatca cctaatccta gtcagaacat
156451 tgtggtatct gcttagggtt gaagtttcct tacaaggtgg taatctccag
```

FIG. 7 CONT'D

```
156501 tctaaaagta ctatacccat gaaacgaacc atatgacttt tgtgactgct
156551 tactaataca tatttatata tgcagcataa ttctaagatt tgtgtatata
156601 actcactagt agcaaaactt caaaggcgaa agtatctgtt accctcacct
156651 atctctaata attaaagacc acttattcac ccgaaagaat catataaatg
156701 taaatggcca aactcactta ggtcagttaa gaagaggagg tactgactac
156751 catacctaag tacctctgag ttagtcatga cttactatgc tctttgttta
156801 aattacagaa aaagatggac tcccttatat tctcccttat attcttccca
156851 agtgatctca tctaccctca tgtctgcaat tactgcttca tgaccactcc
156901 caagtatcta tttttagtcc actctgtctc ttaagctcct aatctataag
156951 tcattcaccc attcaacaaa aatttactca atacatttaa aatacattgg
157001 gcaatacatt tgccaaccgg gaagcaagta cagaattcac agtctagcac
157051 agggatcggc aaactataac ctgtgtatca aatctggcag gctatctgtt
157101 tctgtaggtc ccaacaggaa tggtttttac atttttaag tggttacatt
157151 ataaatgata ttaagtacct acatcatgct cttattttg cctctttgcc
157201 ctcaaatgct aaaatattta ctatttgtcc ttttaaggaa aagttagcag
157251 actaggtgca gtggctcacg cctgtaatcc caacactttc ggaggtcgag
157301 gcgggaggat cacttgagca cagccatgct cagctgattt ttcattttt
157351 gtagaggtag tatctcattg tgctcatgtg tgcacctaca gttccagcta
157401 cttgggggag ctgagatgga ggattgctta agcacaggaa gtcaagggtg
157451 caaggagcca tgatggtgcc actgcatttc agcctaggta acagagtgaa
157501 accctgcctt ggaaaaaaaa aaaaggtttg ccagcacctg gtctagtgga
157551 aatgagagta ataatgagtg ataaaaatgt gttaagctgg ccgggcacag
157601 tggctcatgc ctgtaatccc agaactttgg gaggccaagg caggcagatc
157651 acctgaggtc aggagttcaa gaccagcctg gccaacatgg tgaaacccca
157701 tctctactaa aaatatcaaa attagctggg catggtggcg cacgcctgta
157751 atcccagcta ctcagtaggc tgaggcacaa gaattgcttg aacctgggag
157801 gcggaggttg ccatgagcca cgagtgggcc actgcattcc agcctgggca
157851 acagagtgag attctgtctc gaaaaaaaaa agtgttaagc ttgagatagg
157901 aaagtaaatg ttaagatctg tatcaagagg agatataatc agagggacag
157951 aaaaaagctc ccaaaagaat taaaatatgt gcatatgtgt gttaagggct
158001 ggaagagaga tggtttaaag gcttcaaact cagtatgctt aaaactaata
158051 tacttgttcc cttcctaaca ccctcaccaa aaagatcccc cacatctcct
158101 ctcctgtcaa tactcctaat gttaggaaac tgtacaacca tccaaatagt
158151 ttcaagagac caatcctgga agactatccc tgtctactca ctttcaatcc
158201 tctgaaatca aacaagtcaa ccagaacagg attcaaacct cccagctcca
158251 cggccactat ctaagagtaa gccaccatca tctaatctgg actactaaaa
158301 tagcctaact agtctccttc catgcactga atcaattttc cacaatgcag
158351 ccggggggt tctttttaaa atgcaaaatc tgtgtcatct ttctcttgaa
158401 taaatgtgt caatgatttt tttcatctct tggcatcccc tgccccacac
158451 aaaaaatgtc atcagaatag ccaaacttaa actccacaga caaaacctac
158501 aagagggcca ggcacagtgg ctcatgcttg taatcccaga actttgggag
158551 gccgaggcgg gaggattgct tgagcccaga aatttgagac cagcctgtgc
158601 aacacagtga gaccctgtctc tacaaaaaaa ttaaaaatta gccaggtgtg
158651 gtggcgtgca cctgtggtcc cagctcttca ggaggctgag gcaggaagat
158701 ggcttcagcc caggaggtca aggctgcagt gagccatgat cataccacta
158751 cactccagcc tgggtgatag agaccctgtc cccaaaacaa gcaaacaaac
158801 gacacctaca aggttgggag acaaagtatt ctaacgaatt ctcaaataca
158851 agcagggtct ggttaaatca ccagctacag gattcatatg catatatgca
158901 gaagaaaatg gaagggcaga agttatgggg cgattgaaga ccctgagaac
158951 aagagaactc ccaaatcatg aatgactaga gactttggaa aggcaacttg
159001 agaacagttg caaatggaag ggatctttg cacacatcaa cattgttaag
159051 tatgatggag ctagacacaa aatcaaagaa ctaaatcct cttcctggac
159101 aatgtcctac aatgaacaga gccagacctc agaaaatagg atgccaatgc
159151 cacccctta aaaaaaaat catcttgtaa caaacaacag aagaaaaaga
159201 tcttgagtgg tgaaactaga aaggctactc tgacccactt cttgctctta
159251 aaagttcagg aaaatctatc aaaaaatgga caggaaagga ttggcgttga
159301 agcccatgct gtaagaaatg agagaatagg aaacagagtg ttgctattga
159351 aagcctactg aaaagacata tacacaaaag tgataaaaac tatcctagaa
```

```
159401 aatgatagaa aatgtgaaat aacattatca atcagaatta gaaaaactca
159451 gaaatgaggt cctagcaatc aaaaaagaat tagaaataaa gcaaaaaatt
159501 atttcagaaa ggaacctagc caagagcaat cttaagagcc agtaaacaac
159551 agataatgct taagagaaac agaatatgta aagaaaaaaa ctgtaatcag
159601 aaatgaaggt gaaaattatc agaagggctg ggcacggtgg cttacgtctg
159651 taatcccagc actttgggag gccgaggcgg gcggatcatg aggtcaggag
159701 atcgagacca tcctggctaa cacagtgaaa ccccatctct actaaaaata
159751 caaaaattag ccgggcatgg tggcgggcgc ctgtagtccc agctactcgg
159801 gaggctgagg caggagaatg gcatgaaccc gggaggtgga gcttgcggtg
159851 agccgagatt gcgccattgc actccagcct gggtgacaga gcgagactct
159901 gtctcaaaaa aaaaaaaaaa aaaaaaaaaa aagaaaatta tcagaaggaa
159951 gtgacaataa aggcacttag attttaaatt catataataa agactcctca
160001 aataagaaaa ccgaagcaat gaaatagagc aaatacttaa aactataaat
160051 caaaaaaaac ttcctgaaat tagaagactt gaactgaaat actgaaagta
160101 cacccaagta cctggggaat ccatccagaa aaaccaacac tgagaaatat
160151 acaagtgaaa ctaacggact tccaaaaaga aagaagaga aaattgcatc
160201 tggacattag gcaaaaaata ttgaaaatgt gaatcaagga ctttatatcc
160251 agtcagaacc actaaattta aagtatacaa gtggcaaaac aactgttata
160301 aacacaactc aaggactact gtttatatga gcactttctg aagaatctaa
160351 tagagaatgg tcaccacaca accaaaataa ctggagagac actgataaaa
160401 ggtgaccgtg agcaatgaat ttatttacct gtagaactaa gattaaatag
160451 tccttataag gtaggcccaa tccctgggcc gtgaactggt gccagtccat
160501 atagcctgtt aggagccagg ctgcacagca gcaggaggtg agcattatgg
160551 cctcagctcc atttcctgtc agatcacggt tggcattaga ttctcataga
160601 aacacaaacc ttgttgtgaa ctgagcacgt gagggatcta ggttgtgtgc
160651 tccttatgag aatctaacta atgcctgatg atctgtggtg caacagtttc
160701 aacccgaaac catcctcccc gacccgccat tcatggaaaa actgtcttcc
160751 acaaactgg cccctggtgc cataaaggtt ggggaccact gttataaggg
160801 aaaaaataca gtatttaact gctacatgcc ctgacaatgt agacacaaaa
160851 ttgaaaggaa gacaaaacat gcatatgaaa tactgagtaa gtgggccagg
160901 tgcagtggct ctcgcctgta atcccagcaa tttgggaaac tgaggcgggt
160951 ggagcatttg aggccaggag ttcaagacca gcttggccaa cagggtgaag
161001 cctcatctct actaaaaata caaaaaatag ccgggtgtgg tggttgcacc
161051 tgtaatccaa tcccagctat tcccggaggc tgaggcagag aattgcttga
161101 acctgggagg tggaggctgc aatgaactga gatcacgtca ctgcactcca
161151 gcctgggtga cagaacaaga ctccatctca agaagaataa aaacaaaaaa
161201 acaactaagt gtattgattg ccttattaac tattaactgg tgagaaaagg
161251 aaattgcatc acatcagatg ctgaagtaga gcagaaaaga ggttaaagca
161301 gtgctgagag agaaatttaa agcacctaat gcaaacatta agaaagagag
161351 aaagtctcaa accaataatc aaaactccca gcttcgacac cctacaacat
161401 aaaaagcaaa acaaacccaa aacaagcaga aggaataaac agaaatcaat
161451 gaaattgaaa acaaaaagta gagaaaatta atgaaaagct agttctttca
161501 aaaaaaaaaa aaaatcagca gactggccaa aaaaaaagag aaaatgcaga
161551 gttataatat tagaaatgaa aaaggtacta tcactacaga ctttgcagac
161601 atcaaaagaa caagggaaaa ctacaaacaa ctctacacac acaaatttga
161651 caatttagat gaaatggacc aatgactcaa aaagcaagaa ctatcacacc
161701 tcactcaata tgaaatacct aatttgaata acgctgttaa ctattaagat
161751 gattatattt gtaattttaa aacttccctt cagggttggg atggtttaac
161801 tagagaattc ttccaaatgc ctaaagaaga actaaccacca atttatata
161851 atctctacaa aaaacagatg ggtacacttc tcaattcact ttatgaagct
161901 aattacaaaa ttacctgaat aacaaaacca gaaagacag cattaaaaaa
161951 aaaagaagaa aaagaaactg caggccaata ttctcaatga ctgcagatac
162001 aaaaatcctt atcaaaatgt taccaactag aagtcactat actagcaggc
162051 ttcattctag tgatacaagg ctggttctgt atttgaaaat caatcaatat
162101 aaaccatact aatagactaa tgaagacaaa tcaatgatta tattattcaa
162151 tgcagaaaaa aatgacaaaa ttcaacatcc atttatagta aaaacactca
162201 gaaaaataaa agcctagagt taacattcta gtggtgaaaa gtctgaatac
162251 tatgtttccc tagattgaga acaagaaaat ggtgtccact ctcaccacta
```

FIG. 7 CONT'D

```
162301 ttattcaaca tagtataaga agttccagcc agtaaaataa ggcaagaaaa
162351 taaagtaaaa ggcatataga tgcaaaagaa agaaaataat cccagccagg
162401 tgctgtggct cactcctgta atcccagcac tttgggagac tgaggagggc
162451 ggatcacgag gtcaagagat caagaccatc tggtcaacat agtgaaaccc
162501 catctcaact aaaaacacaa ttagctgggc gtggtggtgc acacctgtag
162551 tcccagctac tcgggaggct gaggcagagg aatcgcttga acccaggagg
162601 cggaggttgc agtgagccga gatcgtgcca ctgcactcca gcctggcgac
162651 agagggagac tccatctcaa aataaaaaat aaaataaaga aaacaatcaa
162701 ttatttgcag aaaagatgat ttaaaaattc caaggaatat accaaaaact
162751 ttccagatct attaagtgag ttcaacaatg tcacagaata caacataaaa
162801 atcaattata tttctatata ctagcaatga acacatagac actgaaatta
162851 aaaatacaaa caacagccgg gtgtggtggc tcacatctgt aatcccagca
162901 cttcgggagg ccgaggcagg tggattgctt gagccaagga atttgagatt
162951 agcctgggca aaatggcaaa acctcatctc tacaaaaaaa agcaaaaaaa
163001 aatttagctg ggcatcgtgg tatatgcctg tagtctcagc tactggggag
163051 ggtgaggtag caggatctct tgagctcggg agacggaggc tgcagtaagt
163101 ggagactgtg ccactgcact ccagccacag cgacagagat agaccctgcc
163151 tcaaaacaaa caaacaatgc tggatgatgg ctcaagtaat cccagtgctt
163201 tgggaggcca aggagggagg actgcttgag cccaggaggt caagaccata
163251 catagcgaga ctcagcttct acagaaaatt taaaaattag ccaggtatgg
163301 aggcaagtgt ttattgtcct agttacttgg gaggctgagg caggaggacc
163351 gcttgtgtcc aggagttcaa ggctgcagtg aactatgatt acaccactgc
163401 actccagcct cagtgacaga gcaagatcct gtttctagct taaaaagag
163451 aaaaaatgga ggggcatatt gtgttcatag attggtagac tcaacttggt
163501 aaagatgttg attctcctca tactgatata caggtttaat gcaattccta
163551 tcaaaatccc agcaatatat tttgcagata cagaattatt ctaaaattta
163601 tacggaaagg caaagtaagt agaatagtta aacaattct gaaaatgaaa
163651 aacgaagtgg aaggaatcaa tctagccaat ttcaagatat attacatagt
163701 tacagtaata acattgtgt gatatcagtg gaagaatata cacattgaaa
163751 agaacagaga acccaatata agcctacaca aatatatcca actgatttt
163801 tacaaaggtg caaaagcaat taaatggagg acatcaatag actttctcagc
163851 aaacagtgct ggaccagata gatattgaca gacaaaaata ttaaccctga
163901 cttaagcctc acaccttaaa aaaaatttaa ttcaaaataa atgtgaaact
163951 ataaactttt aggaaaaacc acaggagata attctttggg atctgggct
164001 aggcaaagag ttcttaaact tgaccgtaaa aagcatgatc cataacagaa
164051 atagttggta aactagacct catcaaaata aaaaactatt ttgctctttg
164101 aacacccatg taaagaagat aaaaagagaa gctagagact aaaaaaaaaa
164151 aatttgcaac cacatatcca agaaaggact agtatctaga attaaaaaac
164201 aaaaacaaaa aacctctcaa agctcaacag gtaaccaacc aaccaatgga
164251 actagaaaat gggcaaaaga aatgaaaaaa tatttcatgg aagaggatat
164301 acacatggca aataagcaca tgaaaagatg ttcaatacta ttagccatta
164351 gggaaatgca aattaaaacc accatgaaat cttattatac atctaaaatt
164401 taaaattgtg atactttcaa atgctggtga gtatggagag ttttcataca
164451 ttgcttgtgg gaatgtaaaa tgacagcacc tttggccatt tcttaaagta
164501 cacatgtaac aaccacagga cccagcaact acacattgga catttatatg
164551 agataaatga aaactcatct acacacacac acacacacac aacctgtacg
164601 caaatgttta caacagcttt attcttaata gctacaacct ggaaacaacc
164651 caggtatcct tcacgcttaa actgtggtac atccatacca tggaacacca
164701 tatagcaatt aaaagaaaca aactgctgat acaaacaatg acttggatga
164751 acataaatac tgtacgagca tcttgcaaga tgttaccact ggggaaactg
164801 gagaaaggat aaacaggatc tctgtgttat attttacaac tgcatgtcaa
164851 tctacaatca cctcaaaata aaggtcagtt tttaataaaa atttaaagg
164901 atatacatca gatgctgagg gggaaggaaa agagaaggtc acaactaatt
164951 tcaataatgt acatgatggg gaatcaatag aaaataacta agaaagagag
165001 gactaaagaa aacaaaaaca aaaccacaaa ctagaggcca aaagtatact
165051 aaaacaaaaa ataaaacaga tcacatacaa tgattatttt acacataaat
165101 atataggtga tgacaaggaa actaggactt gactttaaaa ccatgaaaat
165151 aaactgcgta tgaatatgac aaaatcaaat ttaacaagaa aagcaatccc
```

FIG. 7 CONT'D

```
165201 taaaaataaa gaaatgaacc taaacgtgta tccatttggt agcataatca
165251 cactatcctg tgtaactttt caacacagca atttaaccct gcatctccag
165301 ttaaccctaa agagaactac caggaaaact ccaaactgtt ctcggtaacc
165351 ctattactgg gtgcagcgct gctggtgttg ttattctgag actgttatgt
165401 gtctatgtgg aataaagcaa atgagtaaaa atgtcatatt ctattattcc
165451 tggtgtcaga aaaaaacagg aagtttggcc taggagaaag acggatatat
165501 gatagaagtt gtttagtaaa atcccatagt cctgaatttg aattggaata
165551 tcaatatatg cattatatgt gtgtgtttat gtgtgtatgt atgtatataa
165601 atatgcatat aaatatgtat acatataaat atacacacac acatatgttt
165651 atatacatac acacacacac aaaattttgt tttaatccta tatctatcca
165701 ccccaagatg tctacttgga gatgtgtatc tccaacgcct agaaacagtg
165751 accaaatcag tgagtgcata gacaatactc tcaaaaatac caccaatagc
165801 aaacagaact ggttcattcc aactaatggg cagaaaaggt acaaggtaag
165851 cctgcaatat cttaacatac caaatatcaa agatatttac gagactagag
165901 tcttgtaaaa actactcaag agctaacatg aagaggctcc aaatgttcaa
165951 agacaataca attattatca attatcaata agacaatgaa ttcaaacaca
166001 catagatttc aatctgtaaa tccaggaaat ggaaataaaa acccaaacaa
166051 ctaaattgtc atcactgaag gatgataatg aactacctca ttattttgaa
166101 aactgataaa ggaaaagaat caagcattta ttttactgtt tctaaacaaa
166151 ttttatcatg gggtaatcta accaattaat aaatgagagg aaggtttctc
166201 ttaatagatg tagtctagct cagctgttcc caaacttttt ggcaccaggg
166251 actagtttca cagaagacaa ttttccatg gactaggaag tagaaggagt
166301 ggtttcagga tgattcaagt gcatgacatt tattgtgcac tttatttcca
166351 ttattattat attgtaatat gaaataatta cacaactcac cataatgtag
166401 aatcaatggg aggcctgagc ttgttttcct gcaactagag gtcccatctg
166451 gggatgatgg gagatggtga cagatcatca ggcattagat tctcataagg
166501 aacatgcacc tagatcactc gcatgcacag ttcacagcag ggtttgtgct
166551 cctttgagaa tcaaatgcag ctgctgatct gacaggaagt ggagctcggg
166601 tggtaataca agcaatgagg agcagctgta aatacagatg aagcttcact
166651 tgcttgcctg ctgcctacct cctactgtgc agcccagttc ctaatgggcc
166701 acggactggt agtggtccag ggttggggat ccctggtcta gcttaaagaa
166751 ggagtgatag attatcacca ttttacaaat cctagtaaat aacagactta
166801 gacaatgttc ctcagtggtg atgtcaacat aacagaaaga gacagccaga
166851 cactacgtgc ctttctgatg gaagagaaaa ccatcacata tgatgcagtc
166901 atgttcccaa ttcccccaaa tcatctgaat ctgataaagc ctccagcttc
166951 aactttgaat ttacaggaaa tacagagggc caatacacat gtcaagtgac
167001 atgataagat gtaaaatcca gccgggcacg gtggctcatg cctgtaaacc
167051 cagcaatcca agaagactgc ttgagctcag gagttcaaga ccagcctggg
167101 caacatgatg aaatcccatc tctaccaaaa atacaaaaaa caactcagcc
167151 aggaatggtg gtacatgcct gtgattccaa ctacccagga gactgaggtg
167201 ggaggactgc ttgagcccag gaggcagagg ttgcagtgag ccaagatcac
167251 accactgcac tccagcctgg gtgacagagt gagatcccat ctcaaaaaaa
167301 aaaaaaaaaa agcaaaattc agattatgag aacctccatg aacccagttt
167351 ctccaacaat aaagtgcata aaaaagacaa agatggtgag attaagagac
167401 cataaattaa aaaggagact ttgagttcac atcaatcaat caatcgcaat
167451 gtgtggacct tgtaatagtt gattccaggt gtcaacctga ctggattaag
167501 ggatacccag atagctggtg aaagcattaa ttatcctcag tggttcagac
167551 agcactgagc tcgtccctct tctgctgaaa ggaaaacccg ggcggtcagg
167601 catttgatta gaatgactgg gctgtcccag tgcctgtgag ggtatttcct
167651 gaagagactg gcatttgagt tagtagactg ataggggaag tttcactctc
167701 aatgtgggtg ggcagcattc aataagctgg ggcccagatg gaacaaaag
167751 aggaggcaag agtaattctt gctgtcagaa ctccagattc tatggtcttc
167801 ggattccagg acttgcacca gcactgctgc ccttttcccc catgatcacg
167851 ttggcaagtg tgataatggt atcgtgtttt taaaaagaat tcctatattt
167901 taaataacat acatattctt aataacaaaa aagtaggaca aaaacagtat
167951 atgttacttc tgaaagacgt catactttgg gaggtcacct gttctacaac
168001 aactggatcc tggctattaa cagaaaaaaa tatttttaa tgcagtgctg
168051 atgtcatata agtagtagag aagagggtcc ctctcccttct ccctctcccc
```

```
168101 acggtctccc tctccctctc cccacagtct ccctctccct ctccccacgg
168151 tctccctcta atggcgagcc gaagctggac tgtactgctg ccatctcggc
168201 tcactgcaac ctccctgcct gattctcccg cctcagcctg ccgagtgcct
168251 gcgattgcag gcgcacaccg ccacgcctga ctggttttcg tattttttg
168301 gtggagacgg ggtttcgctg tgttggccgg gctggtctcc agctcctaac
168351 cgcgagtgat ctgccagcct cggcctcccg aggtgccagg attgcagacg
168401 gagtctcgtt cactcagtgc tcaatgttgc ccaggctgga gtgcagtggc
168451 atgatctcgg ctagctacaa cctccacctc ccagccgcct gccttggcct
168501 cccaaagtgc cgagattgca gcctctgccc agccgccacc ccgtctggga
168551 agtgaggagc gtctctgcct ggccgcccat cgtctgggat gtgaggagcc
168601 cctctgcccg gctgcccagt ctgggaagtg aggagcgcct cttccggct
168651 gccatcccgt ctaggaagcg aggagcatct ctgcccggcc gcccatcgtc
168701 tgagatgtgg ggagcgcctc tgcccagacg cccgtctgg gatgtgagga
168751 gcgcctctgc ccagccacga ctccgtctgt gaggtgagga gcgtctctgc
168801 ccagccaccc cgtctgagaa gtgaggagcc cctccacccg gcagccgccc
168851 catctgagaa gtgaggagcc cctccgccca gcagccgccc cgtctgtgaa
168901 gtgaggagcc cctccgcccg gcagccgccc cgtctgggaa gtcaggagca
168951 tctccgcccg gcagacgccc catccgggag ggaggtgggg ggcagccccc
169001 gcccggccag cctccccgtc cgggagggag gtgggggca gccccgccc
169051 ggccagccgc ctcgtccggg agggaggtgg agggcagccc ccgccggcc
169101 agccgccccg tcgcggaggg aggagggggg gcgcctccgc ccggccatcg
169151 ccccgtccgg gaggtggggg gtgcctctgc ccagccgccc ctgctgggaa
169201 gtgaggagcc cctctgcccg gccaccactc cgtctgggaa gtgtacccaa
169251 cagctcatcg agaacgggcc atgatgatga tggcggtttt gtggaataga
169301 aaagggggaa atgtgggaa agatagaa aatcagattg ttgctgtgtc
169351 tgtgtagaaa gaagtagaca taggagactc cattttgtt ctgtactaag
169401 aaagattctt ctgccttggg atgctgttga tctatgacct tgccccaac
169451 cctgtgctct ctgaaacatg tgctgtgtcc actcagggtt aaatggatta
169501 agggcggtgc aagatgtgct ttgttaaaca gatgcttgaa ggctgcatgc
169551 tcgttaagag tcatcaccac tccctaatct caagtaccca gggacacaaa
169601 cactgcggta ggccgcaggg tcctctgcct aggaaaacca gagacctttg
169651 ttcacttgtt tatctgctga ccttcctcc actattgtcc tatgaccctg
169701 ccaaatcccc ctctgcgaga aacacccaag aatgatcaat aaaaaaaata
169751 aaattaaatt aaaaaaataa ataaataaag tttacaccaa ggctggctta
169801 aaaaacaaaa aaagaagagg agaggtcggt caagttgaac ctaagaggga
169851 agtcataaaa agtaattaag tgaaatgaaa actatgaagg tagctgccta
169901 tttcatactg ggaacaaatt aagtcctgac ccctgatgcc aggttggaga
169951 gttaaaccta aattaacact taggttatac aacataaaat aactacagca
170001 aatatttcag gaacagaaaa atggaagtaa aatatatcag caagccagaa
170051 gaaatgatca gaaatgacca gatctgaaaa atgaaaagaa ccaaacagaa
170101 ctctgagata tgaaaaaata attattaagt tagcacacata accaaaatta
170151 agaactgaac agatgggttt tacagcaaat ttaaagtagt ttaagagatt
170201 ctgtgaactt taagacaggt cagaagaaac cgtcaattat gaaataaaag
170251 agggccaaag atgacaaata tagaaaagag ggtaagaaac ataaggata
170301 caataaaaaa tacaaaacag tgtttgtttg ggttcctctg gacagaagca
170351 actgttagga gataatagct aagaattttc cagaattgat aaaaaacaat
170401 aaaccacaga ttcaagacac ccaacaaact ccaagtggga aaataaaaag
170451 atttctttc ccaggaggaa aatatcctag aaggagccag agaaaaacag
170501 attatcttca aaaagcaaca gactaaaaac tggccaggtg cagtgcctca
170551 cacctgtaat cccagcactt tggaggccta ggtgggcaga tcatctgagg
170601 tcaggagttc aagaccagcc tggccaactt ggtgaaaccc catctactaa
170651 aactacaaaa attagctggg tgaggtggtg ggcaccagca atcccagcac
170701 tttgggaggc tgaggtggga ggagtgtttc agcccaggag ttcaagaaca
170751 ggctgggcaa cataatgaga catctctaca aaagattt taaaaattag
170801 ctgggtgtgg tgctgtgcac ctggagtctc agctattcgg gagactgaga
170851 tggaaggatc gcctgagccc aagaggttga ggctgtggtg agctgtgatt
170901 gtcccactgc actccagcct gggtaacaga gagagaccct gtctcaaaaa
170951 aaaaaaaaaa aaaaagagt cagtttgtca gttttagtc tgttgggtt
```

FIG. 7 CONT'D

```
171001 gttttgtttt gttttgtttt gttttttga dacagaatct cgctctgttt
171051 ttgtttcctt cttatatagt cctcatactt catcaactct aactcttgta
171101 cttctatcct gttgccctgg tgaaaagtta actctgggtt gtttcaattc
171151 tcactccaaa agctgagttg ctaagtgtgc aacagaaaaa ataaattact
171201 caacctccat tataggtata acaaattcta ggtctctaac ctcaattaag
171251 ctctcaatgc ttactgtctg gaaatctttc caggctttcc tagttagatt
171301 ttgcacaaaa agctactgct caagccccct tccaaatcgt ccttcctctc
171351 agcagaagac caggcctcat atttattgag aaaacagaaa ctatcagata
171401 gtagcaactc cctcaacttc ctaacgtgca cgtccaaatc tcctccccaa
171451 tcccaagatc cctgtctcct ttcatcctat cacaatgaca gtgcaagagg
171501 tggctagctg tgcactgaat ctaattattc tctcatcaac tgtccccttg
171551 cttcatcaat tatccatctc ctctctccca tctttcaagt attctatttc
171601 ccatatcatg agcatgacca tgtctttcac ttaaaaaaaa aaaaaagaac
171651 ctttctcaat ctacattttc tttttaactag ttcctgttct cttttgccaa
171701 aattttgaa aaagtagtct agactgtctt cacttctact tatttagtcc
171751 actccatcca aaattccatt ggctctgctc ttgccaacat tatcagcaac
171801 cttctattca tggaacacaa tccttaatta catggtacct ttgcgggaga
171851 acacttcatt cattctcatc tccttgactt ccataacacc acattcctgg
171901 ttttcctcct ctttggtctt cctccttcat ccatccatgt tgctcttccc
171951 aaggttttgc ctattcatct agttactcta caaacccttt ctaggttatc
172001 atatatatct ccatggcttc aattatcaat taagtattaa taactctgga
172051 taatccagat ttgtttcctg atgaattctg aattgggcag taatatgtaa
172101 cttttcaatg ttataaatag aatacatgta agggaaaatc tagttaatct
172151 ttaaatacag aaaaatattt gtatctggca tctaaaacgt actatttatt
172201 attttgctca cctgtatata ttctaggtta tgattaatca atacagcaat
172251 gtggaaccat tacctttttt gtcataacag ctttgagata taattcactt
172301 accaacaatt cacctaaagt atacatacaa ttcaatggtt tttagtgtat
172351 ttcactgagt tataaaacta ttaacacaat caatttatc atattttctg
172401 agaggaggtc tcactatatt gcccaagctg gtctcaaact cctgggctca
172451 agtgatcctc ccatctatgc ctcccaaagt gctgggttac aggcatgagc
172501 caccgcgcct ggcctatatt ttcatcacta cataaagaaa cctttatcc
172551 tttagcagac acttaccatt ctaccaagct ccccatctca gtcttacaaa
172601 accatttatc tacttttgt ctctatagat ttgaaaatgc tgacataaaa
172651 tgtcagatgt cagacgtcaa tcacccctcc aattatagct ccctttagct
172701 agcatccttt aagtaaactg ctgtatttct aagtaaacag attttggtgt
172751 gttctgcaag tcccataacc ttgggaattt aagcagctta aaattttaag
172801 cccggatctc tctcctgaac taaagtatct cctggatcac tccctagaaa
172851 accccacatg ttccttaaga cattcaaaac tgagttcatc attttcctca
172901 ctggtcttac ttaatttact gttttcacct tatctgtaga taacagcact
172951 ctctaaaagt gggatattca actacctcaa aaagtagttc caagaattaa
173001 ataaataaa cattaataaa agcagctcgt gtcacgaagc aggcagtcat
173051 caatgtttgt ttcccttttc tgtctacagg ttgtaatctc catttccaat
173101 attaaatgcc attacttttc ctgtccattg aggttttaac atcaatgatt
173151 tattttcat ttctagcaag tttatttttg tagtacttct taatgttttt
173201 aggtccttct taaaatgatt caatcatctt aaaaatattt attttacagt
173251 ctttctctga ttacctctat tgctgaattt cttaggagac ataagactga
173301 cgttttggt gtctgtatta tctgtgatat atttcttcct gtgttttata
173351 attttggatt atgaacctgt tctcttcctg tgctagtgag accatccaaa
173401 atttgaaaca tttagcctct ctataagagt aactaaaaat caaataactt
173451 agaatctaaa tagcagaaat tatattaaat ttgctatttg aatggcatcc
173501 tctctggaag acaagcatta ttttgatcta aaagtctttt tctagtatgt
173551 gaaattaaga ataaatcgga aacttcaaac ttccttctct atccagttcc
173601 actggtctgc cagttacaga ttaaaaaaat atagcagggg gtggagaagt
173651 ttattaataa acctaacatc aaaaattaaa gcttgtttta cccttccaaa
173701 aaagcctatt cctactccac tgcagacaga aaattccact gcgttaatat
173751 tacaagatat caactagaat ttttttaaaa aattaagaag ggagtgagat
173801 ttttcacttt acaaataact gaaatgggat tccttttttt ttttttttcc
173851 tcttcacaga ggtaatcaag ttaggatttt tttttttttt ttataattt
```

FIG. 7 CONT'D

```
173901 taagttctga ctgaaagtat aggtttagga ctaaacacag gacattatgt
173951 cctaagagtt taaaatttta gagcaatacc atgaaataat ttaatacaag
174001 aataatatca attaggcctg tgcagtggct cacgcctgta atcccagcat
174051 tttgggaggc cgaggtgggc ggatcacttg aggtcaggag ttcgagacca
174101 gcctggccaa catggtgaaa ccccgtctct actaaaaaca caaaaactag
174151 ccaggcgtgg tggcaggcgc ctgtagtcgc agctactcag gaggctgagg
174201 cagaattgct tgaacccagg aggtggaggt tgcagtgagc cgagatcacg
174251 ccactgcact ccagcctggc gacagagcca agactctgtc tcaataaaaa
174301 aaaaaaaaag aagaaaaaaa gaataatatc aattaaatta gaataaaaag
174351 aactattaca aattatattt tcattatctt gattgtggtg atggtttcat
174401 cagtgtatgt acgtgtgtga aagagtatca aattgtgtac agtttaaagc
174451 tgctttaaaa aatgtgactc aaattgcaaa aaaatctatt cctatgtacc
174501 ttcttaggta ttaaagccac aagagctaca caatggaaag accataagag
174551 tggctctgtc actaactagc tatgtgatcc tgaacctatt acttaacctc
174601 tctgaacccc agagtcccca cttaggaaac gaggatatca caatctatct
174651 ctgggacagt acagtgaaag taccttccat aacaagtcct tactgaacat
174701 ctacaaaata tgacttgttt actgtacaaa gtaaagtata cctatataaa
174751 gcattcatta aaacttgtgc tttattacta agttacaatg tgagtaccaa
174801 caacaaacct accttacata gtccaaaatg tacatatcac tattatattt
174851 tttcatcttt ctactttcaa actgtgtctt tgtatttaaa atgctgctac
174901 acaatcccag cactttggga ggccaaagca ggcatatcac aaggtctgga
174951 gtttgagatc agcctgccca acataatgaa acccgtctc tactaaaaat
175001 acaaaaaatt agccgggcgt ggtggcaggt gcctgtaatc ccagctactc
175051 aggagggtga ggcaggaaaa tcgcttgaac ctgggaggct gaagctgcag
175101 tgagccaaga tcgcgccact gcactccagc ctgggcaaca gtgcgagact
175151 ctgtctcaaa aaaaaaaaaa aaaaaagctg ctacatagaa gccaatatgc
175201 actgtagcca aaatgcacta catagtgcaa aatgtattta aaatggacag
175251 tatgcagttg ggtcttgctt cttaatccag tctgacaatc tctgcctttt
175301 aatcgggatg ctttagtcaa tttaaatgta tcataatgac tgatattgtt
175351 gaaatcaggc atttcattat ggtattttg ttttgatca tctcgtttgt
175401 tttttatttc tcttcctgcc ggcctgtctt catttgggtt aatcaatttt
175451 tttttttttt tttttttttt ttttagcat tccattagat attcctctcc
175501 tggcatttag gttcatcttt taattttgag atttctcact agggatcaca
175551 actgtgactt taacttaaaa caatctattc agagttaatg ttctacctac
175601 taaatgtcaa gaacccaact tgtgtgccac acatacatgt actacacatg
175651 ccaccactgc atgcatagta tttaaaaact gccaagaatt tggacagatc
175701 ttatatgcga atttttttgg actcactttc tttgtagctg cctctcttcc
175751 aggatttacc cactaagttt cttgctgttc tgttagccca gaactctgta
175801 tccttacatt tcatgcaaat aaggttgtgg tattcttcac caagtagcag
175851 gaggattaca gagcaccctc agacaaaaac ccaccaactc atgaatttca
175901 caagatagtt atgttttaag aataggctct cctccagttt gtctgctttt
175951 gatcactctc cagtaccttt aaagaaaaat taatgtattt tgtccagata
176001 ttatcattgt tatctatagg aaggtaactc tacagtattg caccattact
176051 agaagccaga atgccacgtt acttttacta cataaactcc attctgaaaa
176101 tgacttaact aggtaattta tgctactatt aggtgtattt ttccttttta
176151 ttttagtagc agctttattc agatataatg cccacgccat aaaatttatc
176201 ctaaaggat aagttccgtg gtttctagta cagagttgta taaccatcac
176251 cactacctaa ttttagaaca ttctcatcac cacaaaaaga aatcacatac
176301 cctttagcat ttgttcccca tgctccttcc cacaacccct ggcaatcact
176351 aatctacttt ctgtatcaat ggatttgatt gcctggacat ttcatacaaa
176401 tggaatcata taatatgtgg actttcatgt ctggcttctt cacttagcat
176451 gttttgaga ttcatccatg ctgtagcatg tataaatact ttactccttt
176501 ttattgctga ataatattct actgtatgga catacccat tttatctacc
176551 tattcttcca ttcaaggaca tttgggttgt ttccactttg gggatattat
176601 gataatgcta taacaagcat tcatgtacgt gttttttcatc ttttggacac
176651 atacctaaga ataaaattgc taggtgatat gggaactcta tgattaacat
176701 ctcgaactgc tattttctaa agttgctgca catcctacca gaagcgtatt
176751 agaattccaa tttctactta tccttcccaa tgctattatt tgtttgattt
```

```
176801 tagccatttt agtgtacgtg aaatgatatc tcttgctttt gatttgcact
176851 tccctaatga ctaataacat taagcatctt ttcatgtgtt tgttggtcat
176901 ttgtatgcct ccttcaggga actgtccaag tccttgcccc tttttaaact
176951 agactgtctt tgtattgttc agctgtagtt ctttacaaat tctggatgtt
177001 aagtagtacc tttaatggat gtatgatgtg caattttttc ctcccatttg
177051 tgggctgctt tttttttttt tttttttttt tggagacagg gtctcactct
177101 gatgcccagg taggcatgat taccacttgc tgcagcctca acctcctggg
177151 caccagtgat cctcccacct cagcctccca agcagcttgg actacagatg
177201 tgcaccacca caccaggcaa atttttaaat tctttataaa gacgaggtct
177251 cactacactg tttaggctgg tctcgaaatc ctaggctcag gtgattctcc
177301 caccttggcc tcccaaagtg ctgggattac aggtgtgagc gagccactat
177351 gcctggccac ttttctactt ccttgatggc gtattttgaa gtacaaaata
177401 ttttaatttt gataaagtcc aatttaccta tatttcctct tgtcacttgt
177451 gctttaagg tggtactatg aaaccagtgc caaggttaca aagatctaca
177501 cagatgtttt cttctgagaa gtttacacat tttagttttt acatgtatat
177551 ctttaatcaa ctttgagttg gttttgcat actgtgtaag gctccagtat
177601 tctcttgtat gtggatagtc atttgttcca tttgttgaaa aaaaaaaact
177651 attccttcct tgtaatactg ttttgccacc cttgctgaaa atcaattgac
177701 ctacccacct accaaaaaaa aaaaaaaaaa agaaaagaaa aaaccccga
177751 aaatataact ggtaaatgtg aaagtttctt tctggactct caattctatt
177801 ccattggtcc atatgtctat ccttatgcca gtatcacaca gtcttaatta
177851 ctataggttt gcttgttctg taaattctga aattgctaaa tataaatatg
177901 agtccttcaa cttagttctt attttcaag ttttgctttg gttattcagg
177951 gtcctttgca attccataca aatttcagaa tcaacttgtt gatatttcaa
178001 aaaaaaaaaa aaagaagag gaagagaaaa agaagccaaa agaaaagaat
178051 agaaaaaaag aaaaaaggca agtcagcttg gattttatgg gaaattgcat
178101 tgaatctctt agttcatttg gagattactg cagcttaaca ttaactcttc
178151 caatccatga acatgaaata tatttccatt tacttagatc tttctttcaa
178201 tgaagttgta gttttcagca tacaagtctt aaactttcag taaacaatga
178251 attcctgata aagaaaataa gtcttacact tttgctgaat ttattcctga
178301 gcattttatt ctttgtaatg ctgttgtaac aaaattgtta ttttgttttt
178351 taagacgggg tctcactctg tcaccccgc tggagtgcca gtggcgcaat
178401 caccattcac tgcagcctca acctctccag ctcaaggctc cctcctctgc
178451 acccaagtag ctgggactac aggcatatgc taccacaccc agcttttaa
178501 atttttgatt ttatttattt ttgagacagg gtctcactct gttgcttatt
178551 tagtctcacc caggctggag gctctactgc tcatcatagt aacacaatta
178601 cagttcactg tggtcttgac ttcccaagct caagtgatcc tcccaccta
178651 gcctctagag tagctgggac tacaggtaca caccatcaga cctagctaat
178701 tttggtattt tttttgtagt gacgggatct agccatgttg cccaggctgg
178751 tcttgaattc ctgggctcag gcaacccacc tgtctcagcc tcctaaattt
178801 tgggaagtat aggcatgtat aggccaccac acctggcctg ttttaatttt
178851 agattgccca ttgctggtat actaaaatac aattgatttt gtatactgtt
178901 cttgtatcct gcaaccttgt tgaaatcatt tattagctct aatagtttt
178951 aagtgagttc tttagaattt tctatccaga agatcatatc atttgcaaat
179001 aaagagtttt aattcttatt ttccaacctg gttatctttc atcttgtttt
179051 cttgcctaat tgtgttggct agaaaatctg gtacaatact gaataggaag
179101 aacaacaatg aatacggttg tcttattcct gatcttaggg ggaaagcttt
179151 acatttacac cattaatatg acataagctg tggatttttc agatgctctt
179201 catcaagaga atgtgaagaa tgcaaaataa aaccataata agacatctct
179251 acacacttgg taaaataatg aaaatttaaa agactggcaa aacaaagtat
179301 tggtgagcat gtggaacaat tagaattctc gcactgttgg tgaatgtaaa
179351 ataggacaac caccttggaa aagaatttca agtttctaa atactgttgg
179401 gctgggcaca gtggctcaca cctgtaatcc catcactttg ggaggctgag
179451 gcaggtggat cacctgaggt caggagttcc agaccagcct ggccaacgtg
179501 gtgaaacccc atctctacta aaaataccaa aattagcagg gcatggtggc
179551 gcacgtctgt aatcccagct actcaggagg ctgaggcagg agaattgctt
179601 gaacccaaga ggcagaggct gcaatgagct gagatcatgc cattgcactt
179651 cagcctgggt gacaaaagca agactctgtc tcaaaataaa taaagacagt
```

FIG. 7 CONT'D

```
179701 taaatacaca cttatatgac ccagccactc tgttcctagg tattgataca
179751 acagagaaac acatagactt gtactgatcc aaaagacata cacatagctt
179801 tataaacaaa tattcatagc agtcttactt acaattgcca aaaactagta
179851 acaactcaaa tggccaacgg taggtaaatg gcctactgtt gtggtatatt
179901 catataatga atatgagtca gcaattaaga agaatgaact ttaggtacac
179951 aaaatattaa tgttaatatt aagttttaaa aaaatcagac acaaaaggag
180001 tatgtattgt catcacattt aaacgaaatt ctggaaaagg caagctgatc
180051 aatgaaagaa agcagattaa tatttgccta agggttaggg acaggaaggg
180101 gttactgcaa agggatatgg aggaacttt gggaagacag aaatatttac
180151 attttgattg caatggtggt tacaaggagg taatcatttg tcaaaactca
180201 tcaagctaaa tactgatgtg tattacttct gtaatttttt aatgttaatt
180251 attctgagaa gtacttaaat tatttgaagt cctttctaaa ttaatctgcc
180301 tcaaagattt tttcgatgat ataattacca atgtcctaat tttttatcct
180351 attaatacca tattatgcac ttggatctgt gttgcttatc aacacttggg
180401 gcggctgata aatattccct gtaattaaaa aaaattgtaa gcagtcaaaa
180451 actaataaac cttcaagagt gttataaata aataaaattt acaataacat
180501 ttacatgaca cctatttaa tgttttgtcc attttatgtt ccaatgataa
180551 ttaggactaa gtggtgagca gttcatgtaa aaatgacttt acagtagtta
180601 taaaaccaaa ctcacactgc tgaagtctac taggcagaag aactgaacaa
180651 gagcaggaag gtgttatata ttttctgaag gtccctaaaa caactctagg
180701 caccagataa ctcctacctc accaaaagaa aaaagaaagg aagaagtaac
180751 catattctga aagtctatag caccaatact atcccattca tagtcatctt
180801 tttgagacag ctcttgctct gtcacccagt ctggaatgca gtagtgtgat
180851 catggctcgc tgcagcctca acctcccagg ctcaggtgat cctcccacct
180901 caacctccca agtagctggg accacaggtg tgtgccacta aacccaggct
180951 aattttttt ttttaaggg atggggttct gccatattgc ccaggctagt
181001 ctcaaactcc tgcgctcaag tgatccccct gcctcagcct cccaaagtgc
181051 taggattaca ggtgtgaccc accacaccag gtcttagttc ttttcttga
181101 tacaagtcag cagagactcc aatttctcca cttcaataaa ttaatggatt
181151 ctttaaaaag agaaaaagat taattaaagc cacatgagcc acagccccaa
181201 caatctacag ttatacccg aattcaacac ctgcagcag tcataactag
181251 gggtctccta taacacctag gcctggatgt ccagctgcct ggtttcctct
181301 ggtttataaa ttcagaactt ttagatttct cttttgctca ttctcccttc
181351 tctgcctttt agacaagaga gctctggacc tcctctcaag gctatcttta
181401 ccctaagcag atctgcccaa catcccttcc tccctaatac ctgcactgct
181451 gtaaacacta tacagttctc tcagaaatag gtccaatatt tactatgtta
181501 ccaaaacaaa agaaaagcat agggagggat atgttggtta aattatattt
181551 aaagtttagc catgaccaca agcatatcat gtcctcacat aatgtcatca
181601 cattcacaaa tacaaaaact tagaatgaag gtgataaacc tggctatgcc
181651 ccctaactgc tgcatggagc tatgtctaac gttatcagaa gactcctgca
181701 ctggtaacta ataacaactaa ttaggaatgt gttctcatta tgaaaatatt
181751 cggccaggca tggtggctca tgcctgtaat cccagcactt gggaggccaa
181801 ggcaggtgga ttacctgagg tcaacagttc aagactagcc tgaccaacct
181851 ggtgaaaccc tgcctctact aaaaatacaa aaatttgcca cttatggtgg
181901 cacacacctg taatcccagc tccttgggag gctgaggcag gagcatccct
181951 tgaactggga ggcggaggtt gcagtgagcg gagatcatgc cattgcactc
182001 cagagtgagt gcactcagac gacagagtga gactctgtct caaaaaaaaa
182051 aaaaaaaaaa aaaagaaaa agaaaaaag atatattct agctattttt
182101 gacaaacact aagcaatata ctaaagaatt tattaccagg agagaaatat
182151 ttagtaagtt aaaatagtgc ttcccaacca ctttcatatc atggcatgca
182201 cagaaaatat ttatacagca tactgagata aaggacaag gctacatagg
182251 ctccaccacc caaatccccg ggtggccacc cctagggcag cacaccacat
182301 gggaaacact gaccaaacag gctctcatgc taatccctg ggtcactgtg
182351 acaaactagg gagaagttca tccatatggc tgtacactgt cacaaacaaa
182401 ccagctttaa aaaatatttg tttctgcttt tctaacttat acatcttcat
182451 caaaccatga acattcaag gcccagttca tccccaccaa gaagccctcg
182501 caaatctcta aggctgtaat tcacacctat cttttctctg tgttcccaaa
182551 cttcctttac tcttactaaa ctatcctgtt ctgttttata gttgccttta
```

FIG. 7 CONT'D

```
182601 gctattattt accttattaa atatgtccct tgaatagaag gatcttgttt
182651 cattcatttt tatttccttc ttgctccaca atattgaaaa aagagtttgt
182701 acaacctgtt tgttcaatcg gacttggggt gggtcatatt cagtgacaat
182751 gcttttgta ctacaatagc ccatgtactt tctccctctg tattccgaaa
182801 ttggatttat ttagttccaa gcctctcaaa tatcccaaat tttccagttt
182851 caagagttca acaggataca caaaaatgtt tgtttgcact agccccacat
182901 ccacaaaatt tagaaaacaa aagcaaatat ccagcccta tcgaactttt
182951 ttatttttta ttttgtatt gttagtagag acaagagttt cgccatgttg
183001 accaggctgg tctcgaactc ctggcctcaa gagatccacc cacctcagcc
183051 tcccaaagtg ctgggattat atgcatgagc taccacgcca ggctgtaccc
183101 ctacagaact ttaacatcca agtatcaatt ctttcttcca agcaaaaaca
183151 aggtttccag aactcaacag ataactgaaa accacactgt tgttaccagc
183201 catagtccct gacagtaact ttaaattgcc caagagcagt gaggaagcat
183251 tttaaattat tttcacatct attgaaggat tccagccaag agaatttatt
183301 cttattatac aggagtaaat acgcatttta tcattaaata gtatgataat
183351 cctaactagg aattatcagc ttataaattt tctctgtaat atctgtgaat
183401 ctatctgaat gctaagattt tatttagaat cacaattttt attttcatct
183451 tcccctccc tttaaaaaat agttaatttt taactactag taagtagaat
183501 aaatagaaaa ataactataa gtgaatactt aatatgaatt agtacacaaa
183551 ttaagttata caaggatcat tcccaaaata tttattgaaa aatgcttcta
183601 tccatttctg atgtttttct gacccttgtt taaaatacca gatgctgaag
183651 ttaactaaaa tttatttatg cataatctaa aaagacaaaa aaagcacctc
183701 aataagcatt cccaagtata tattatttca aaaccaagat acatatagtc
183751 atggaagtag tttcaaattt acagtcagtt caaatttata aaaagatact
183801 aactgtatag tccattgctc tctgctagct gaggttaaca ctgtataaaa
183851 gctggtttct acttttctc taccacccat atatgcatct ctacaatctg
183901 tagcccaata cttagccaac atgatcatcc ttctcagtct actgaattcc
183951 tttttccctg ctgattcaaa tgttgaggaa tgcacatgca atatccaatc
184001 cctctaatta tttcaatgcc tgttcagcta ccttcctcca tactctattc
184051 agctttctac ctttcagtcc ctattattat catttgcat aaagaaaaat
184101 aacaacagta tctgtcttaa caccctctgt aaacaccaca aagatatgct
184151 gaagagttgg atctgtaccc ctttgtgtt tctgaaacag gaaatgcaaa
184201 gaaagtatac aggttccagg acctcctaat accaaaatcc aaggatgcat
184251 aagtcccttt atataaaatg gcatagtatt tgcatataac ctatgcactc
184301 ctcccacata ttttaaaatc atctctagat tactataat acctaatatt
184351 atataaatgc cacataaaca gttgttacac tatttatttt tttctttatt
184401 tgagacaggg tctcactctg tcacgtgggc tggagtgcag tagtgcagtg
184451 cttggtgaag ccttgacctc ctcaggtcaa acaatccttg tgcctcagcc
184501 tcccaaggag cttggactac aggcacacga caatgcaccc agatgatttt
184551 tttttttttt tgtattttt gtagaggtag ggtctcactt tgttgcccag
184601 gctggtctag aactcctggc ttcaagcagt cctcccacct aggcctctca
184651 aagtgctgag attacgggca tgagccacat gcctggcccg tattattttt
184701 tagtaaaatc actttccaaa atactgcaat atgaggaaac ctttattcca
184751 aaaagtctac tcataataac ttataaacat ctttggaagt taaaattaa
184801 ccacatcaac ctgcttagcc cacataaccc acattaaccc acatcaacct
184851 gcttagccca cataatccac attaacccat attgtggttt atgttttaaa
184901 aggagaaaaa acactgaaac taccatatgt cttaccttt aggcatacat
184951 gttaaaattt tggcagatga aacataatac tgatagatga cgcttcaaaa
185001 taatgcaggg aagagtagaa gtgggtagag attgttaaat caagtttagt
185051 ctaaagcagt ctccttacat atttgaagtt cagtctaaag gtttctctgt
185101 acatagtgaa ctataaatgt atctaaatgg aggtgtaaac agactgtaac
185151 ctactttgt gccaatcacc aagttttggc cagttaaaag gggcaactg
185201 ttcaaaccat gttcaaataa ggcaaatgcc gagctgtaac caatctgact
185251 gtttctgtac ctctgtctat acatcttctt ccaccacctg gctgtgctgg
185301 agtctctctg aacatactgt ggctcaggag ctgccctat tcacgaatca
185351 ttctttgctc agttgaactc tttaatttga ctaaggactt tctttaaca
185401 agatataaat tacacaaacg accataaatt ataattgttt taaaatgcca
185451 catgggagtt caatatatta ttctctctac ttttacatat gtttgaaagt
```

FIG. 7 CONT'D

```
185501 tttataaaag agagcttttg ttttttttgtt gttgtttttt ctgagacagt
185551 acaatctcag ctcactgtgg cctccacctc atggactaaa gagatcctcc
185601 cacctcagcc tcccaagctg ggactacggt tgtgaaccac catgcttgcc
185651 tactttttaa attttgtgta gagatgaggt ctcactgtat tgcctaggct
185701 ggtcttgaac tcctagtctc aagcaatcct ccctcctctg tcttccaaag
185751 tgctgggatt acaggtgtga gccactgtgc ccagccagaa ttttgttaa
185801 gtgtgttatg ataaaacaca taattaaaaa caagtgattt ttgattttct
185851 gaaatcagaa aacctggtta ccaactagat gagtggacaa cattcattat
185901 ttttctacgc cttaaatttt cacatctgtg aaaaggagt tggactcatt
185951 aaattccaac gttcctgcta gttccatttt ttttttttaa caattcaact
186001 gaatgacttc cacactttga atttggttta acaattctaa ctaaaatcca
186051 gaatgcattc atagctaaat cttatataat taactgaaaa ttgttcatta
186101 ctgttaccaa aataacaatc tagtacagta cttacctcag ctgggccttc
186151 attcctatat aaatcctatt ttgcttaccc tgaaacacct ttccttcaag
186201 tattacctct tagacccttc attctctata gttaacgttg tcaaagaaaa
186251 tagaggccac taagtataat ttgttccagt ttccctaccc ctaatgcagc
186301 ccatcctcat ttctgcctgt acttcaagtc cttccacct gaggctgctt
186351 caagatctct ccacatctca cacatctctt atatttctta ttcccttccc
186401 caacaactcc ctacttactc tatctaggct cagtcgtttg ttccttttct
186451 aaccaagtcc tcaggtctct tttgctctgg cttcttcagt ttagcctagt
186501 caacaccacc cttcttaaca aataaaaaac aaacgaacag ccttcttttcc
186551 accctacgtc ttcctcaagc taacctgtga ttcctccttc ccatgactac
186601 caaatattta aatcaaagct ctaactagtc taaatagctc aactccaact
186651 cactccttag ctcatcatga tctagcttcc agcctccacc accctcagtt
186701 ttcccttctc actggccccc aaagagcaaa tacaatgaat ggcttattgt
186751 aaggtctcat catgcctctc ctctctgtag catttgatac tgcaattact
186801 gcccctcctt caggaaactc tcctccctaa gttcttatac accatttttcc
186851 tgctaagctt cctacagact ccctcagtac cattttcacc tcttctccta
186901 atatgatttg gttcctcagg gttctttcct cccctgctcc tcttttccttc
186951 ttatccctac aatccctcac ctatattatc atcttactct agccattgct
187001 tgagctatta atcttcacca ctggatacgc tagcctagaa gggcctgtga
187051 gcaaaatcta gaccccccaac tgatttcata ataaagctt tattagaata
187101 caaccacact catttgtttg cctacagtct atggctgctt ttgcgctcaa
187151 gacacaggtg aatagctgca atacaagcag aatggccctc aaagccctaa
187201 tatttaggct tttaaaaaat attatggctc tttacaaaaa acttgccaac
187251 ctctattcta taaggtaaaa tatgccaaaa gattagtcct aataactttt
187301 tctgcttttc aatctcagtg ccaacactat agtcaggcca cccatctgag
187351 accttgaggg ttttctgtta ctcccaaact ccccatctga gaccttgagg
187401 gttttctgtt actcccaaac tctcttctca tcttccaccaa tccatcccct
187451 atggtataac caaagcaatg cttctaaatg cacaaatcta tttcactgtt
187501 taaaatgttc cccagcgaaa aggttttttca caatctggct cttgtctgtc
187551 ctacccaaat ttcaaattac tccacacctg aatattgaaa aatatttctt
187601 tttttttttt ttttttttaag atggagtctc actccattgc ccaggctgga
187651 gtgcagtggt gcaatctcgg ctcactgcaa cctctgcctc ccaggttcaa
187701 gcgattctcc tgcctcagcc tctgaagcag ctgggactac aggtgcacgc
187751 caccacaccc ggctaattat tgtattttta gtagagacag cgtttcacca
187801 tgttggccag gctggtctca aactcctgac ctcaggtgat ccacctgcct
187851 caacctccca aagtgctggg attacaggt taaggccacc gcgtccagcc
187901 agaaatactg ttactttagt tccccagaat ctatcacact atctcttact
187951 tccaggcttg cccaagattt accataaata cctacacatt tttctacttt
188001 cagctcaggc acaatcacct ccatgaagcc ttcagtgact tacccaggcc
188051 aactcaggtg attctttccc catgtgcccg ctccactagg tacacacttc
188101 cattacagga aatatttact tgctttcaca taatctgcct actagtctat
188151 acattccttg agcaggaacc ctgaggtaga gtaggaaaat ggctattaag
188201 ggcatggagt tttaaagttg gaaatctggg actcagtgcc agttctgccc
188251 cttcctaact gtatgttctt aacaaattaa gaagaaatg aagaaatgaa
188301 gaactcattt tcttcctctg tataatgtaa actttgtgag gattatttaa
188351 ggttattctt ataaacacag tgccttacac atagttaagt gctcaacaat
```

FIG. 7 CONT'D

```
188401 tactggttat cattattttc attgttttat ccctcacact cagtaaagaa
188451 ttcgaatagc tgctgagtga cataactgaa gcaagctagt tctgcactgt
188501 tttcagctgc atactgaata ttttcatctg aacaacactt ggatcccgag
188551 aactcattat ttttatgccc aaactgtttc aattagagca atcaacttgt
188601 taaggtttgt ccaggacttt ctctgtttga acactgaaag tcctgtatac
188651 tgggaactac ctcagttcca ggcaaaccaa gacagttgat caccttagag
188701 ttatgttgca aacaacagca actgacttgg gtaaatttaa gaagaaataa
188751 agggaagagt gaatttattg gtagaatgta tagagtaatt cacaaaacca
188801 agacaaagct gaagaatcaa gcctacgaaa gcaactccca catatctagc
188851 cggcaggaat taacggatgg ttaccttcac agtacttctg tcaagatgaa
188901 tcaattaggt ctcagtatca gctcactcaa gatttaaatg ccagggacaa
188951 attagcctaa tttgtgttag ccagaaaaat gtgaggcaca ttaattaatc
189001 agaggcagga gcacctacat taaaaatccc accataagat agccaatggc
189051 agaaaagtag cttccaaagg ccaaatcaga aggttgtttc caaaagcagg
189101 gggaatggat acaatgcccc tcatatcagc tgcagcttaa acatgccaag
189151 cctttagact ccatgacaca gtcactgtta ttcatactat ttttctttct
189201 gagttggcaa actcatcctt caagacctac ctcaagtatg accttctgtg
189251 taaccttact aatttcccca ggtacaatca cacttttttct atactcttat
189301 agtactttac aaattatcta cctgtatcat agaacttacc acactgtaca
189351 ctagccatat gcttaagtat cagtctctcc cactaaactg aacttcctta
189401 gatcagggaa tattttcata tttataatct ttggcaccta atgatgtcta
189451 catagcatgt agaaaatact aaataggctg cgcgcggtgg ctcatgcctg
189501 taatcccagc actttgggag gctgaggtag gtgaatcact tgagcctaag
189551 agtttgagac cagcttggac aacacggcga aaccctgtct ctacaaaaaa
189601 taaaaaaatt agctgggcgt ggtggcgtgc acctgtccag ctacttgaga
189651 ggatcactcg agcctgggaa gttaaggatg cagtgagccg tgattgtgcc
189701 actgtactcc agcctgggtg acagagcaag accctgtctc aaagaaaaaa
189751 aaaaagctaa ataatgttt aataaatctg tttcccaagt cactagaata
189801 tgtaaagcat caaataaaaa gaaacatagg ggctaccaca agtaaatatg
189851 ctgacagtat caaaagaaag ctgatagacc aaaagcaagg gaaggacaag
189901 ccaaaaaaat taagaagagc aaaaactcca caagcgtaaa aatcaagaag
189951 aaaattctgt taatttaaca acctgaaggc atcacttatg taaaagcaaa
190001 acccaatatc catatgcata atggtgattc tcaagaacca agaaaacaac
190051 taaattatat tctatttaag gcaagtgtca aaataaagta aaatctagta
190101 tgtatacaac ctccctaacc cagaaaacca agaatgatta attccaagta
190151 aatatagtca tgatttattt taccatattt taactgctga tgttggctat
190201 gctgtaagaa aatttttctt aacagcaaaa ctgcaagaaa ggatagctac
190251 atcctcctta tacttttaat attccttcac ctccacttga aaatgagaat
190301 acagtcctcc ctctgtatcc tcgggggggt tggctccaga tgctccctcc
190351 cccgaagata ctaaaatctg cagatgctca aatctcttct ataaaatggc
190401 acagtacagt cagccctacg aatccacagg ttacaaaggg ccagctgtac
190451 agccaaaccg tatgctaact aaacaaaagg tcaactgagg agtggtgtca
190501 gtcatagaaa gaaaatccta ctgactctga agttagaagt tctagatata
190551 cactttgtaa ctcctttact ggataccaag aagttacttt ttttccact
190601 tcttgaaatg tcatcaattt catgtcccat ttcccccaaa taactaaaat
190651 tcacttcaca aactgttaag taactttcac attgatggca ttaaactatt
190701 tgttctttat cacctgaacc ctacgatcat tcttattatc attactgaga
190751 tatattctaa ggtacacact accaccaact gaagtttaaa taaattaata
190801 gaagcttaac ttgaagctaa tcaagacttt aaatcaaact tccagtttag
190851 actgggctca gtggctcatg gctataatcc cagcattttg ggagattgag
190901 gagggaggac tgcttgagga caggagttca agaccagcct gggcaacaca
190951 gcaagacccc atcgctacaa aaagtaaata agctggacat ggtagtgtgc
191001 acctgtagtc ctagctactc aagacgctga ggcaggagga tcgcttgagc
191051 catgatcgtg tcactgcact ccagcccagg taacagcaag attctgtctc
191101 aaaaataatg tttaaaaatt ttttttttaaa aaacttcca gattacaaaa
191151 aatctgaagg gtggtaaaaa aacaaataag aggaaccagt taagcaccac
191201 cagaaggaaa cagacaaacc cagtaattag gacagtctat taggctaaat
191251 atgaaattgc caatacttgg ctgttgttac aaacctggaa aaaagcaatt
```

FIG. 7 CONT'D

```
191301 tcatatagtg caatttaata aaagaaaact gacccgaaca aattagtggc
191351 atttttaaat ggttgggaga caacagacta aagttggaaa caatccaagt
191401 attcatctat agatgaatgg gtaaacaaaa tgtggtatat acatacaata
191451 gaatgttact tagccataca aattagcctt aatcactaat tcattcacta
191501 tgtatatacc ttaatctccc agaactttac ctgtcataat aaaaagcttg
191551 gagttgattt gggaagcagt aggaaaaggc actaaaagag taaacatttc
191601 agttcaaaaa tacacatggg aaaaattatt gtgtctgcgg tgcctacgat
191651 gtatttattc aaggaatatt ttagtgcttg cttggttcta gccactgtac
191701 taagtggtag gcaatgaaga tacatagtct gtgccctcaa aaagctcaca
191751 atctagtagg aaaaataaaa tctaattaaa atacattatc ataattgcaa
191801 cgagaaagat acactcagac ttcttccagg agcaaagaat ggtacctacc
191851 cagagttgag tatttaaaag tggtaggaat tagccaggca acaggaggca
191901 gagaaggata ttccagtcag caagatggcc ctgagaatag aaatagcact
191951 ggcgaggagg ggcaggcggg attccagatt atgtataagc atataagaag
192001 ttcagtgttg ctagggctta aggggtggg ggaggaaggc tgaatctgga
192051 gaaataatca ggcatcaggc tcactgaaaa atctcataaa ctaaaggaag
192101 aaaaccactt tggagatagt ttttaaacag gaaggtgaca ggtaataagg
192151 cctaaagtag gctggaggca gcagaatata gaggcagggc caaaatccag
192201 agacagcaca gagattcgag ctacataact ggcatctgac tgaatgtgga
192251 agaggagaag tccaagaagc ctctcaagtt tcaaattcag gtcacagtga
192301 gggtgatgat gccataaaca gaaaaagaa aaaacaaagg cagaacatgg
192351 ctttaaacac tttgagcttg agaagctaaa aagatgctca tgtgaataat
192401 ttccagcaga tgattttatg aaatttaagt ccccgcacat tgaaatgatg
192451 attaaagcca agggagttgc tgatatgagc aagaaaaaca gtctacagat
192501 aaaagaatcg tagacagaat cccaagccat gcctactaca ttcaaagggt
192551 aggaagaaga cttaccaaag ctgactgaaa aagagtactc caagagaacc
192601 aggaagcagt atatgcccca ttagtgaatt catgaaaaaa aaaaagtttg
192651 tttgctatat ggcatataga ttcctgaaac actttacact ctccaaactt
192701 aggaagaaga gggaaatgca caggatggat ggtcgttaag cacctttaga
192751 cactgcatat ggttaaacag agccaagagg cagaacatgg gtgcatggcc
192801 aatatgcata ctcctgggct tgatccgttc aactgtttct gtactttatg
192851 ttcaactgtt gttatttaag agtgctaaac attaatgtga tactaaaaat
192901 cacatatgaa ccaatatgaa ctttgcctta acattttttt attaaccatt
192951 caagtatgag cgagttcatg ttacagaaat acattatagg agaacaggct
193001 gttcaaggag ggctaggcaa cagtatcaat gccatggagt caacaccaaa
193051 agaaaattaa tgtcttagaa taatactgaa cctttcattc ccaaatgtag
193101 acttttttca ggtatatcat ctagtctctc ttctcattaa gtttcatgtt
193151 tcaagttaca tccaaggtat ctattctcac tgagcttctc aacagagccc
193201 aaatacttta atagctatac aaacacagaa tttgttgtac atcacagcaa
193251 tttatcccaa ataggtgaag gaaaattcac ctaggaaaac actagagagg
193301 aggaaaagaa tagggactga tagtaccaag tatactgtaa gtcaggaaag
193351 gctcatggag aactttaaa gtttttttt gttttggtt tttaactaga
193401 atgacatggt gtggcagaat tgtaatcttg gtgttccaga gatatatgaa
193451 ggagtctcac tgaagagata ggttgccaga gtgaaccca actcaacaga
193501 tagtcaaaag aaggcacaca gaacagcata tacaaaggca tgaagaagaa
193551 actactggtt actcaagcat ctccagtact ttatcacagc tggcacaaag
193601 gagatataag gaaagtgca aggtgaggta aaaaggtaa ggtcttacaa
193651 ctatgtgtgg catgctaagg actttatcc tgaagtcaat gggaaggatc
193701 ataaacagga aagtaacaca gaaagatatg agaaagatca atccacaaga
193751 tacactgggg agagaagata ctgaacacag aagagctagg tacactatta
193801 tacttgttca ggcaacaaag ataagggtct aaactagggg cagaggaagt
193851 aaggttggta acaggtacaa acatgagggt tcttcagata actaatacaa
193901 agaagggtga aggagggaa gagaagggag tcaaggatag aatcttaaac
193951 ttggacaatc agatagtgcc acttagcact ggaggttcca gagacagaag
194001 caagtctggt agagctaact gaattttgca ggtgagaaaa tatatattag
194051 ccctggtatc agaaactaaa gcataaagct taagtgttaa gcccaaagat
194101 acggattatc atttttggt aaaaccaacc aactggctcc ttgctgataa
194151 gaaggaaact ttgcaagagt aaaaagataa aaggcaaat aaatctaata
```

FIG. 7 CONT'D

```
194201 gtaaagttca tcaaaaattt gcaaggtttt aaagtataga aatagcaatt
194251 tctgtgatat agtcgatatt tcttcaatat tttccccatt cactaacttt
194301 caggcgtggt ttgtacatgt caagtcttag actcccttcg gtggagtaca
194351 gcacagtaag caagagttct agctttagca tcaagcttta tttgtttgtt
194401 tttgagacag agtttcactc tgtcgcccag acttgagtgc agtggcatga
194451 ccacagctca ttgtaacctc tgcctcsccg gttcaagtga ttctctcgcc
194501 tcagcctccc ttgtagctgg gattacaggc atgagccacc aggaccggct
194551 aattttttgta ttttttttttt tttttgaga cggagtttcg ctctgtcgcc
194601 caggctggag tgcagtggtg cgatcttgac tcactgcaag ctccgcctcc
194651 cgggttcacg ccattctcct gcctcagcct cccgtgtagc tgggactaca
194701 ggcacgcgcc accatgcccg gctaattttt gtattttag tagagacggg
194751 gtttcaccat gttggccagg ctggtctcga actcctgacc tcgggtgatc
194801 cacctgcctc ggcctcccaa agtgctggga ttacaggcgt tagccattgc
194851 gcccagccgc ttagcataaa gctttgatat attgtaagtc caggctttgc
194901 cacttaacac ccgatggaag acttaaggcc acttacttaa gggttgtagg
194951 cctcaagttg cctcagcagt aaatggggat aataatagta cttacttgat
195001 ataggactgt tgtgaagatt aaatagataa tctatataaa gtacttagca
195051 ctgatatact gtaaacaata aatgttaagg tttttaaaat aattaattac
195101 tgttactaat gaaaatgtca caccccttgag gtatacagca gcaagaaaat
195151 gagttgacct ggattgcagt tacctgagca tttgttttgt aattattcat
195201 taaacagaac atttctgttt tgcacacttt tctataagtt atctttgaaa
195251 acaggaaaag ttttaagaa tcaatgcctt acatgaaaag gtctagcatt
195301 aaaatgcaca ttccaggacc gggcatggtg actcatgccc ctaatcccaa
195351 cactttaga ggccaaggca ggaggataac ttgagctagc agtttgaaac
195401 cagcctgggc aacatggcaa aaccccgtct ctacaaaaaa cacaaaaatt
195451 agccaggtgt ggtggcatgt gcctgtagtc ccagctactc aagaggctga
195501 gatggaagga cggcttgagc ctgggaggag gcgaaggtta tagtgagccg
195551 agattgggcc actgcactcc acccttggcg acagagccag accctctttt
195601 ttttttttttt ttttttttaaa aaaaaaaagc acattccaga acaaataaaa
195651 ggaaatgttt cccttttcaat atgtacttcc tagttttttgc tacaaaatgc
195701 atcccctacc caagctccaa atttctatca gtgatgataa ttactccctc
195751 ccttcctcca tttataaacc tcagaataac ctttactccc tttctcttca
195801 gtgatcttta taaagagaat ttgaaggagg aggaagaggg aggaagaaca
195851 gcatcatcaa atcctcattc caggttgtag ccattcccag tctcaatttt
195901 ttggaaaact cttctttgca gatcagacaa cagcgctatt tctccaaaat
195951 gaattctagg tattactgcc ctgtcaccct ttccattgct ctaatcatgt
196001 tacatctcct ctttgctctg gaataaattc cttcacatct ccctattaag
196051 aaaaagcttc caagcaactc tttgccacaa gatattcttg catcaacaca
196101 ggccacctgg aagtctcctc tctttaatat aatcactctt ctttttttacc
196151 tggatattta ttcaccagtt aacatgcccc tttaagttt ggtacatatt
196201 tcctataaga ttcactaacc tcatttttttt tttcctctcc aaagatctct
196251 taaagtctct ctcgattgaa tgacaaagaa atttcttcc tcaaccctct
196301 ctctactcaa atccctggc ataactctat ccttttattt tctttaacaa
196351 gtatggatct tattcttgca cctaacatct tgtgtatcag ctgcttctat
196401 aatttataac atgttttagt ttttgtctat cctatatgtg aaaaaatagg
196451 catcatagct tatcaaagtg catctcactg ttttggaaca gcctgataac
196501 cacaactact cagttacaga gctaagttgt actgtttcta atggacaaga
196551 ctaagcatgg ttatctactc ttagatatgc ctaaatcccc aataaaggcc
196601 cttcatcaga tttgaccccca gtttaccctt tagtctctct ctctcctaca
196651 tttctctcag gactcttcaa ttactgctcc ctctagtctg gaatgcccct
196701 ttcttccacc agccttctcc cgcccttttgc ctggccacct ttctttcatc
196751 cttcacaatc agctcactcc cattcatcca ttagaaatca accagagtat
196801 cttccctttc tgctcacctc caagtagttt ttttggcatg cattttcgga
196851 atactatact gtaacaattg ttgttctgca ttgtaattat caccccact
196901 ggactgtaaa ctccctgaag tacagactgc atcttattcc ttatccccaa
196951 gacctaacat tgatagatac ccaatagaca attagtgaat aaataatacc
197001 catatccact gagtgacatg cacaggctac ataagcacac tgaggttttt
197051 tatctaaagt tccagctggg tgtgacgact agcatctgta gttcgaacac
```

FIG. 7 CONT'D

```
197101  tttggaaggc cgaggcggga gaatcactgg agcccaggag ttcaagacaa
197151  gcttgggcaa caaagcgaga ccccgtctct aaaaaagatt aaaaaattag
197201  ccaggtgtgg tggtgtccgc ctgtagtccc agctacttgg gaggccatgg
197251  tgggaagatt ccttgaacct agaagtttga gcttgcagct gagctatgag
197301  tgcctgagca ctccaacttg ggtaaaggag caagactccg tctcaaaaaa
197351  tactttactc atgtaaagtg gggataatgc cacacttcat atacttgtta
197401  cacagattaa ataaggtatc atgaagctcg taacagtgtc tgccacatta
197451  gaactaccat ttgaatgtct atttcatgtt ttagttacac tatagaatcc
197501  cgagaaatgt aatgttgtga ccaataccag gctgaatggc ttagcaacca
197551  tgctcttttt catgcatcta aaagtcacgg gttacattct tatcagcaaa
197601  tatttgttgt gtacctatta tgtgcaggag tccttactaa gtatcactga
197651  gctaccagaa cacaatagag gtaaacaatg aaacaaaaac ctgtaccaat
197701  atccgagaga agaatgttac tggttttttct gtacaaacaa tgagtatttt
197751  tcaataaatt tttatttgga acaggatagg cttcaagaaa aattcctaat
197801  gggaaaagtt caaaattaac acttgtcatc aagtggacca ataacaggag
197851  gcagttccaa aatttcttgt tcctattccc aagtttttact ttcgcttaga
197901  tgtatttctt acaaagggta tttaaccatg accaggaaag aatatatgat
197951  ctttatttga ctcatttaaa tgggaattcc acggatatct ccctaggttc
198001  tttcctacta gtatttaatt ttgtagctct gaaaaacggc ctgagtttgt
198051  ctgtttctct acaaaataga acactgaatg gtatatttac cccacaacct
198101  tccttaagac aggataaaac acacctctta atcacactag cttatcaaaa
198151  attacaaaac tgcaaatcat gtcgcctagt attagcaaag aaggctgcgg
198201  ccttaaaacc attttccccc taacaaatcc aaaggtcacg gtcccagtga
198251  agtttgtgca ttatacttac tgttttcagt agctgcagag agacctctag
198301  cgctgcctca ataagccgag tttgcaaata gtacctgcta atgtcacctt
198351  aatgagacaa tggcaacatg ctgagtagca actaactgag tgaccgcgat
198401  gaatgtttag ttttgcaacc acttggaaat tctactagct tggagcaaga
198451  ggtatgtaag agaattatga acctgtgtat ccaatttatt ttagtaaaac
198501  gtgtcaaaga aattatcacc ctatgcacac cccactccaa gaaaggctaa
198551  gaaaacaagt cctatgagcg gaggtcggag caacctcttt tccgaagcct
198601  gaacacaata gatggcaaac tattgtccac cttcagctcg ctccaaatgc
198651  cagcagttgc aggagtatga gctgcaacag ctcggcacga ctagtccaaa
198701  gacgagcact ggaatataag aaaatggtcc tggcgcatcc tacccctccc
198751  catcgatcac cctcaaacaa gtcagttacc cggctggtcc ccacccccct
198801  ctgcgggccg ccaccgcccg cctgggcccg gctcgcagaa ggtaggagcc
198851  cggaccggca gagccgaggc tccatgtgag ccgcgcggga ggcgcagagg
198901  gggctgcacc ggacggaagg ttgcaccggt ggcgggcgca agcagcggcc
198951  gcccccctcgg ctgtgcggtc ggagggcccg ggcggcagca tccccgttca
199001  tccgggcggc cctggcccgc ggaccccgcc tcagctccac atcccctcct
199051  cgccgacacc aggccgcgcc cgcgtgacgg ggccgaaaac gccggcattt
199101  cccggtcgcc gcgccggcag ctccgggggg tgactgcagc ccggccggcg
199151  tctcgccgcc cgctccgccc agcccggggc cgcggtgacg ggaggcggcg
199201  gccaactccg gccgaccaca agccgacgag aaccagcccg cgccggccc
199251  cccgcccctc cccgcgtcgc cgggccggcg cggccaggcg ggcccagacc
199301  gcggaagcac actcacttcc acatcgcggc ccttgttctt gaagctcttg
199351  atgcggtggt ctccaagct ggggttctcg gccatggctg cgcgcggctc
199401  cggcggcggc tactcctgcg gctgcggcgg cggcggcggc gaatcttgga
199451  gcgggagggg gaggagggg agagcgggag ggggagggg gagagaagag
199501  cacgttctgt gacgcctccg agcgcgagga ggcagtagca ccggggagg
199551  cgcggaccaa cagccgggcc gggtgggcg gaacggagc tgagagcggc
199601  gcgcggccgc ggaggctggc gacacgtgac cggggcggt gaccggcttg
199651  ggcgttcgcc gggctatacg tgcccgttgg ttctcgggat gaccctgccc
199701  tcttcccctg caagggctct ccacaacccc tcggtgctgc aagttttgtg
199751  ccagaaatgg agccggacct ggcgactttt actgcccctc aggcgcgggg
199801  cggcggtcgt caactacagt tccatcatg ccacgatccg cctggagtaa
199851  ttctccacgc ctagtgagaa cgaggagaat gccgggaccc ttccgcgcgc
199901  ggctctttgc gcgccgcgct catgttgctg ggcacaaagc tccgcccccca
199951  caaggccgcc tctgggcggg gaagagcggg ggagcgtccc tggcaccttg
```

FIG. 7 CONT'D

```
200001 cgccctatca ggaggaagag ggcgggcctt cctgggagcg cacctcgctg
200051 cctgtagcta gaagatcaga aaaggaacaa ccgcgagtgc tttgcagtct
200101 cgcttttttg ggggtcttct caaatagcca ccttcattcg ctcttcccat
200151 gctctgcttc agttttataa atagcatttc tacctgacat gtacatgtgt
200201 atgtatgtga tacgagtgtt tatatgcgtt acctaggtgc ccgcgcggaa
200251 attcagctca atgagagcag gtactttggt tgaattactg ctgaatctct
200301 agtgtcaaaa caatgcctac cacgtcgtag atacgcaata cttgttgaac
200351 tggcgcttta gtgtcgccca gtttcttcat catccttcca agcccggttc
200401 tgcaaccttc actctggcag tccctgtatt tacatgcccc ccaacacttc
200451 ttgttctacc accacacaga atcttagcct tcaggcagca gcccagccct
200501 ggtccgcaga ctctcctgtg tagcactccc actccctctg ggggcatcga
200551 aagaatgaaa gagggaaatt tggatggatt acactgataa agagctgctt
200601 tcggccgggt gtggtggctc acgcctgtaa tcccagcact tgggaggcc
200651 gaggagggca gatcacaagg tcaagagacc gagaccagtc tggccaacca
200701 tggcccgcat ggtgaaaccc cttctttact aaatatacaa aaattagctg
200751 ggcgtggtgg cgcatgcctg gaggctgagg caggagaatc gcttgaaccc
200801 ggtaggcgga ggttgcagcg agccgagatg gcgccactgc actccagcct
200851 ggcgacagag ggagactctg tctcaaacaa aacaacaaaa acaacaacaa
200901 caaaaacaaa aagctacttt ctggagcagg tgggcttcat ttgcttgtat
200951 gttaattttc agaatctatg gtagacatga gcaggtatgt aatgttgtag
201001 tacttataat tgaactgagg tcaaaagttg gtaggactat accatgaaga
201051 gatcaaaaag gacaatcttt aaagcgaaag ggccttggct gggcgcggtg
201101 gctcatgcct gtaatcccag cactttggga ggtcgaggtg ggtggatcac
201151 aaggtcagga ggtcgagacc agcctggcca acatggtgaa accccacctc
201201 tactaaaaaa aatacaaaaa ttagacgggc atatggcgca tacctgtaat
201251 ctcagctact tgggagcctg aggcaggaga attgcttgaa cctgggaggc
201301 ggaggttgca gtgagctgag atcgtgtcac tgcactccag cctaggcgac
201351 agagtgagac tccatcccca aaaataaaa ataaaaatt caaacaaccc
201401 aacaaaaaca tgcaaaggac actgatcaca gaaaaagaat aaatatatga
201451 ggagatacag aaaaaaaaaa aaaaaaaaa gcgaaagggc cttaaagaac
201501 ctgaggccca gaagtcagga attcagaagc ctttggtggc caagctatgt
201551 ccaggggcat tcgtcttgtg agtggtgggg tgtggcctat tgataaacac
201601 aggcttcaga tcctctggtc atactggact gtgcccagt gttgccagaa
201651 gattccactt ttcaaggaaa accaaaagg tagattctt ttctctttat
201701 ttttaaatgt taattcacat tttgttaatg gacttaagca tttcagtcac
201751 ttcagaatat caggtcctca gtttgcaaca cctgatctta gtctaaccac
201801 tcatttgaag ggaaacacac acacacacac cagctatgaa tttagaagga
201851 atacattagg cagggcacag tggctcatgc ctgtaatccc agcactttgg
201901 gaggctgagg tgggaggatc acctgaggtc aggagtttga ccagtctg
201951 gccaaccatg gcccacatag tgaaaccctt tctctacaaa aatacaaaaa
202001 ttaggcaggc atggtggtgc atgcctgtag tcacaggtgc tcaggaagct
202051 gaggcaggag aatcgcttga acctgggagg cggaggttgc agtgagttga
202101 gattgcgcca ctgcactcca gcctgggtaa cagaatgaga ctctgtctca
202151 aaaaaagaa aaagaaaga atacattagc tcaactctgg gttttaagga
202201 aacagaactt gtgtgtttgc cattctcctt ggctaaatgg aagagaaatt
202251 ttcagactgt tgctcagtct ctattataat ttagtaggta ttccctttc
202301 aggttacttt atgccacctt tcttcacacc cagtccaaag cagggctgcc
202351 cttttgcctg gatctagttt actcattttt attctttgcc agtacccctg
202401 gtaacttcag cattcacaaa tgtggcaccc tgacaccaca gtctttctac
202451 atccttaact tcaccaagtt ttttaccact caagtggtaa aaagtgcaag
202501 cctgcaccag accttggaga ccttaatctc tgggaaatga ccacctccag
202551 ggactcaaat ttggtgcttc tcattgttag aaactatctc cttctctttt
202601 gcctcactct aatcatcatc cttggcctga aacttctctg gacagctctt
202651 cttttaaatg gatttatttt ccacacatat tgtgagtgtc tactgtatac
202701 caagcattgt attcatcggg cacatgtatg aaggactagg gggtctcggg
202751 ggagacagga aggaagggcc ctcagcccag gggtcaatca aatcctctga
202801 ctcactctcc accttcccaa ggcatgggga gtcatgccag cagtcagtca
202851 ggtagcagta tgccgtaggc aacacaagca taacagatgg gaaaaggact
```

```
202901  tcatgatttg cctcctaagt cagcttcttt ctgcaaactc acccctctat
202951  tactggcata accattcttc cagggacacc tctccaagct aagagccgtc
203001  tttacttctt gtctctctcc ctcaactccc tcacctagtc accatgttaa
203051  ttcaccactc agtgtttctg gcatctctct cttcttccca tgccacccac
203101  gagactacct taacacctcc taagcagtcc acctgcctcc ccaatccctc
203151  cacagcaatc tgactcactt ctccagatct tcctgacttc atctctgctc
203201  ccaatcagca tacccttctc ctctgccatt gtctgtcaaa tcatttataa
203251  actcagtcta gggccaggct ccgtggctca cgcctgtaat ctcagcactt
203301  taggaggccg aggcgggtgg atcacctgag gtcaagagtt caagaccagg
203351  ccaggcgcag tggctcatgc ctgtaatccc agcgctttgg gaggccgagg
203401  caggtggatc acgaggtcag gagatcgaga ccatcctggc caacatggtg
203451  aaaccccgtc tctactaaaa atacaaaaaa attagccagg cgtggtggcg
203501  ggtacctgta gtcccagcta ctcgggaggc tgaggcagga gaatggcctg
203551  aacccaggag gcggagcttg cagtgagccg agatcaggcc actgcactcc
203601  agcctgggca actgagcaag actccatcaa aaaaaaaaaa aaaaaaaagg
203651  agttcaagac cagcctgacc aacatggtga aaccccgtct ctactaaaaa
203701  aaatacaaaa agttagccag gcacggtgcc aacgcctgta atcccagcta
203751  cttggaacgc tgaggcagga gaatcgcttg aacctggaaa agggaggtta
203801  cagtgagccg agatcgcacc actgcactcc agcctgggca acaagagcaa
203851  aactccacct caaaaaatat acatattaaa ataaataaac ttgtctagtg
203901  gttaagatca tatgtgatgc agccacagtg caagatactt ttttcttatt
203951  tttggttccc ctgcacattg ctcatgcttc agctaacatg ttctgctcac
204001  cttttccaa gtatatctta acctttccag tttttacatc tttgccattt
204051  gacttgctca gatggccctg cctctgtctc tgcctgtcaa catcgcttcc
204101  tctttgaata ctcatcccac atggtcacct tctctatgaa gctttcccag
204151  cgtggtactg tggaaggatc ttcagaacct gaaaattcag gtcccagggc
204201  tgatcctatc agatcaagcc caggtaagtc aattatctgc cctcaatcct
204251  cttttcatct acaagtaagg atcctgaatc actggggttt tgtgagaatc
204301  aaattctaaa atgcatgtgg aagtgctttg aaattgctct attaatatta
204351  gttgttacta tcttcctagc caggagtaat atgtttccct ctgaacctca
204401  gaagaacttt acttatggtt ttgtattgct gcaatttgtg tagtcttatc
204451  tctctcttac ctattgctat ggtgtaaaca tctatgtccc tccaaaattc
204501  atatgttgga agctgatacc caatgtgcta gtattaacac gtggagtctt
204551  ttgggaagta atgaagtttt catagctctg ccctcatgaa tggattagtg
204601  ctcttataaa agaggctgca gccagtgtgt acctgtggtc ccagctactt
204651  gggagactga agtaggagga tcatttgagg ccaggagttc aaggctatag
204701  tgggctctga tcacacttgt gaccagccac tgcactccag tctgggcaac
204751  atagcaggac cccatctcca aaaaaaaaaa aatgttgaag ggagcgccgt
204801  agtgcctgtt gcccttctgt ctcttccacc atgtgaggac acagtgttca
204851  tccctcctgc catgtgagga cacagtgttc atccctcctg ccatgtgagg
204901  acacagcaac aagcagagag cagccttcac caaacacaga atctgctggg
204951  accttggtct tggactccag aactgtaaga aataagtttc tgttggccgg
205001  gcgggtggc tcacgcctgt aatcccagca ctttgggaag ctgaggcggg
205051  cggatcacaa ggtcaggaga tcgagaccat cctggctaac atggtgaaac
205101  cccgtctcta ttaaaaatac aaaaaattag ctgggtgcgg tggcgggcgc
205151  ctatagtccc agctactcgg gaggctgagg caggagaatg gcgtgaaccc
205201  gggaggcgga gcttgcagtg agccgagatc gcaccgctgc actccagcct
205251  gggtgagaga gagagactcg tctcaaaaaa ataaataaat aaaataaaat
205301  aaaataaaat aagtttctgt tgtttataaa ttatcaggtc tcaggtgttt
205351  tgttctatca gcatgttcta tcatgcatgt ttgctgaatg aacaaatgaa
205401  ttaatgagtg aatgaataaa ctccttctt ccctcatgat caccttttgg
205451  ctaattcacc acactttaag cacacctgaa gcaaagagca aatactgaaa
205501  attgaagaaa atgacatcca aatgcatcaa cccagctacc tagcagtgct
205551  cttacctcag tggtaaagaa atgtaaaata ataagtgttt tcatttactg
205601  aattcctgcc aggaatttat atacatcatc tctaatccct gtgaaagccc
205651  tgcatggttg aaattatcat ctccatctct ctctggggca ggcggagctt
205701  ggagctctgg ttccaaggca tggtgagagt ctgtggtgtt ggcaggaaca
205751  acggaagcaa aaagacacag aaagacaagt ggtttctctt gtggccaatg
```

```
205801 tctagaatag cagtaatgaa gacctccact ctccccaaag aacaaataca
205851 gtccttagac tctaggaaag taaggtctcc tctccaaggg gtgtcccctg
205901 tgcggggagc atcagtcatg gaaatgggtg tgcctagcag ggcaaccatc
205951 tcgtgatcca tgatagtcag tagcagcaga cagcattgta gcagtaaggt
206001 gaaaagtcag agaggaagaa ccagataaat ccccagaaat aattggggac
206051 acctcaagcg aggctagtgt ctggccagta agcactgata cataattatg
206101 tggataacac aaataagata acctcaatgc ataataatgg gctaatgggc
206151 ctgggacaca cacattgtcc cccaatatca ttttcaaata attagactac
206201 aataaaataa acaatgttaa aattgtagtg ggcataattt agaatatact
206251 taccgtctca aggtcatgat tctgcatgat tttacacata tgtgaaatct
206301 gcatgatttt acacatatgt gaaatctgca tgattttaca catatgtgaa
206351 atctgcatga ttttacacat atgtgaaatc tgcatgattt tacacatatg
206401 tgaaatctgc atgattttac acatatgtga atctgcatg attttacaca
206451 tatgtgaaat ctgcatgatt ttacacatat gtgaaatctg catgatttta
206501 cacatatgtg aaatctgcat gatttacac atatgtgaaa tctgcatgat
206551 tttacacata tgtgaaatct gcatgatttt acacatatgt gaaatctgca
206601 tgattttaca catatgtgaa atctgcatga ttttacacat atgtgaaatc
206651 tgcatgattt tacacatatg tgaaatctgc atgattttac acatatgtga
206701 aatctgcatg attttacaca taagtgaaat ctgcatgatt ttacacatat
206751 gtgaaatctg catgatttta cacatatgtg aaatctgcat gattttacac
206801 atatgtgaaa tctgcatgat tttacacata tgtgaaatct gcatgatttt
206851 acacataagt gaaatctgca tgattttaca catatgtgaa atctgcatga
206901 ttttacacat atgtaaaaat ataattttat actactagat attataggac
206951 acatatatag atataatttt aaaatactag atattatagt acatatatgt
207001 aaaaatataa ttttacaata ctagatatag aaccaaatgg taccttagag
207051 atgaacacag tcctggaagt ttagtaactt gctggttctt taaataacaa
207101 gcagtgtgtc cttaacagg ttatttcata taagtagcaa gttgctcact
207151 tgtgaaatga gcacgttgga ctgggtgatc ttgaagcctc ctctcacagg
207201 cataatgctt tgaacctgtg agcccaccac tccagtccag cagcatctct
207251 tctcctgtct ctccctattt tatagatgag aaatacaaag acagtaaatg
207301 atcataattg tcaaacggac cgaaagttga gtgttctgat ttttttccac
207351 tcatgtccag tccttcatgg gccttctgat tttccagaag ctgccactgt
207401 gctcaaccca ccagatcttc cctgtctcaa atgcattagg ccaccaaatc
207451 accctcaaac caaagttttc gctctcaaaa tagttgagat aggctgggtg
207501 cagtggctcg tgcctgtaat cccagagact taggaggcta aggcaagagg
207551 atcgcttgag cccaggagtt tgaggctgca gtatactgtg aatgcaccac
207601 tgcactccag cctgggcgac agaatgagat cccatagctg aaaaaaaaaa
207651 ttaaattaaa agttattaag ataaatcatt atctcagata agaaataatt
207701 cactcacggt aaggtatgaa tgaccttatt aaaccatgtg aactccagca
207751 gatggaatgt ctgatatatc taacctatta ttaacatcca ccctcccctc
207801 cccacacaag aaaacaaaaa gcaatccttt ggcatccaat ttcagctgat
207851 ccctgctgga agttattttg ataatactag ggctactggg aagtgacctc
207901 tttgaacgaa taccagattt gttatctgtt tctgcatcat cttctccagt
207951 aaacacgagt acctggagga aagcatttat gtcttactca ttttttgggtt
208001 ccctgtgtct aatatggtac atagcacatg atggggcctc aacaaatgct
208051 aggtggatta ataaataaac tcaagtagaa aaaaaaatta accttaccca
208101 ttggagggga atccataaaa tgtttggtat aataaaaatg aggagcaacc
208151 gggcgcggtg gctcatgcct gcaatcccag ccctgtgcgg ggctgaggcg
208201 ggtagttcac gaggtcaaga gatcaagacc atcctggcca acatggtgaa
208251 accccgtctc tactaaaaat acaaaaatta gttgtggtgg cgcacgctac
208301 tcaggaggct gaggcaggag aatcgcttga acccaggagg cggaggttgc
208351 agtgagccaa gatcgcgcaa ctgcactcca gcctggcgac agagtgatac
208401 tctgtcaaaa aaaaaaaaaa aaaaggaaa agaaaaaaga ggagcacatt
208451 tctttttgc ataaaaagt catagtctgg tgaagatggg gattatggtt
208501 ataaataat aataggctgt ggtggctcat gcctgtaatt ccagcacttt
208551 gggaggctga ggcaggcaga tcacttgagg ccagcagttc gaaaaaatta
208601 gccgggcatg gtggtgggtg cctgtaatcc ccgctactcg ggaggctgag
208651 gctagagaat ctcttgaacc caggaggcgg acgttactgt gagctgggat
```

FIG. 7 CONT'D

```
208701 catgccattg cactccagcc taggtgacag agggagactc cgtctcaaaa
208751 taaataaata agtaaataaa tacataaata aaaataaaaa ataatcgggg
208801 gatggcaggg agcaggggag agcattaggg aaaagagcta atggatgcag
208851 ggcttaatac ctaggtgatg ggttgatagg agcagcaaac cactgtggca
208901 catgtttacc tatgtaacaa acctgtacat cctccacgtg aaccctggaa
208951 ctgaaaaaaa taaaataaaa taatgatttt taaaaatcac caacatgtag
209001 agacgtaaat aggaaaaaaa aatgatcaat gacaactact gagtgtgcac
209051 catgtgccag gaaccacgtt aagcctttc tgggattact tcttttaatt
209101 ctcacaacag tattatcagg tagaaactat ttttactcct attttataga
209151 ggaagaaact gaggccaaaa aatgctaagt aactcttgca cagtcaggag
209201 gagagagggt ccatgcaact tgattgcagg gcccatgtct gtaatttggt
209251 tttctgcagg caagcacgca gagagatggg ggagagccat gtgtcctgtc
209301 tgggtcacaa tacctagaga tacctccttg atccagcaca aacaaaacgg
209351 tttccacagg acaataatgt tatatttagt tgcaaaacaa acaaacaaaa
209401 aaaggtctag gtaaactggt taccaaaaga ggaagaatta aacaagtgtg
209451 aaaagctagt ctctactgaa aagagatttt tatcgtcaag tcagcaggac
209501 taggagagga ctcagacaaa ccactaaatc cacaagtcgg acaaaaaagg
209551 gcttgtcatc tagagttgta ttaagtagat aactttttat cctttgcata
209601 ttgccatttg gaggagacat actctgctta ctaattatgg agcgttaaag
209651 actccagtct gtaaatattc agctctaaag tcattcctgg aaaacaaggt
209701 aacgggaggc aggagacacc tgaaagtagc catccaaaag actggttcat
209751 tagtttgatt gtaaacattc tcctctgtcc ctactatttg aggaatttat
209801 gattccctag gttggaaaat acctagagaa ctgaaatgtg cagtaacaat
209851 gcttttttt tttttttt ttgagacgga gtttcctttt ttttgcccag
209901 gctggagtgc aatggtgtga tctcagctca ctgcaacctc cgcctcccgg
209951 gttcaagtga ttctcctgca tcagcctccc aagtagctgg aattacaggc
210001 atgtgccacc acgcccagct aattttgtat tttcagtaga gacaaggttt
210051 caccaggctg gtctcaaact cttgacctca ggtgatctgc ctgccttggc
210101 ctcccaaagt gctggaatta caggcgtgag ctatcgcacc cagcatttt
210151 tttttttttt gagacaacgg ctcgttctgt tgcccaggtg ggagtgcagt
210201 ggcgcaatct cagctcactg caacctccgc ctccaggtt caagcaattc
210251 tcatgcctca gcctccgag tagctgggat tacaggtgtg tgccatcatg
210301 cctggctaat ttttgtattt ttagtagaga tggggtttcg ccgtgttggc
210351 caggctggtc tcaaactcct agcttcaggt gatctgcccg cctcggtctc
210401 ccaaaatgaa caatacagtt ctgggcacac tgtttcccc ctatttcaaa
210451 tttctatgtc ccttataatc aacattgcca atacattaat aatccttagt
210501 gaatggccaa tagaaatttt ctaaaagaaa ttttcttac ctaacttgta
210551 tgagtctttt aactttagg tctatttccc tttaaatcct gcagtttaaa
210601 taactttgct ttggccaggt gcggtggctc aggcctgtaa tcccagcacg
210651 ttaagaggcc aaggcgggtg gatcatgagg tcaggagttc aagaccagcc
210701 tggcgaagat ggtgaaacct tatctatact aaaaatacaa aaattagctg
210751 ggcatggtgg caggtgcctg taatcccagc tactcgggag gctgaggcag
210801 agaattgctt aaacccggga ggcggaggtt tcagtgcacc aagatcgtgc
210851 cactgcactc cagcctgggc gacagagcga gactctgtct caaaaaacag
210901 aaaagaaaag taactttgct ttggataaaa tgtgtttttt cctccaacta
210951 cactttcaca ttttctctct tgatacgca gatgttctat ccatgagatc
211001 atagtagctt aagcatttat agacaaggca gtgtgatgtc ctatagttat
211051 gctctccagt acagctgcca ctagctacat gtggctattt aactttaaat
211101 ttaaattaat gaaaattaaa tgtaactaaa aattaagttt ctagggccag
211151 cacagtggct catgcctata atcccagcat tttgggaggc ctaagcaggg
211201 aatctcttga gaccaggagt ttgagaccag cctgggcaat attatgagac
211251 ccccgtctct acaaaaattc ttttaaaaat ttcttttaaa tttttaaatt
211301 taagccactc ctagctactc agaaggctga ggtgggagga ttgctcgagc
211351 ccaggagttc aaggctgcag tgagctatga ttgtgccact gcactgcacc
211401 ctgggcaaca gagagcaaga cctgtctcaa aaaaaaaaa attgagtttt
211451 tcttcacact agtttcattt tatgtgcgca atagtcacca tattgtgggg
211501 actgtattgg taacagagat atagaacctt atcacagaaa attctgtggc
211551 taccccagaa agaacacaac acacgtttag caacagacag accttcatct
```

```
211601 tttcaatttc caccttaatc ttttactaga cttgtgacca tgggaagttt
211651 cttaaacttt caaagtttca gatatttaaa ctataaaata gaaatacagc
211701 tgggtgcagt ggctcatgcc tgtaatctca gcactttggg aggccaaggc
211751 aggtggatca cctgaggtca ggagttcgag accagcctgg ccaatatggt
211801 gaaacctcat ctctactaaa aatacaaaaa attagccggg catggtggca
211851 ggtgcctgtg atcccagcta ctcaggaggc tgaggcagga gaatcgcttg
211901 aacacgggag gcagcggttg cggtaagcca agatcacatc actgcactcc
211951 agcctgggtg acagaatgag actctgtctc aaaaaaaaaa aaaaaaaga
212001 aagaaaagaa aagaaaaaaa aagaaaaaga aaaagaaag aaacacaaac
212051 atacctacac ctgtgtggtg gtagtcagta atgcccaaca cactttattg
212101 cttaataaaa ctattattat tagtgcttag ggatcaaaca ttcccttttt
212151 gatccaaagt aaaaaagctt ttgaggccag gtgtggtggc tcatgcccgt
212201 aatcccagca ctttgggagg ccgaggcagg cggatcacct gaggtcggga
212251 gtttgaggcc agcctggcca acatggtgaa accctgtctc tacttaaaat
212301 acaaaaatta gctgtgcgtg gtggtgcacc cctgtagtct cagctacttg
212351 ggaggctgag gcatgagaat cgcttgaacc tgggaggtgg aggttgcagg
212401 gagtggagct cgtgccattg cactccagcc tgggcaacag agcgagactc
212451 cgtctctcca aaaaaaaaaa gaagctttta agattcaaag tagatatcaa
212501 tatttcttc ataccttgag tactcaataa accttgcaga ctaccaaaaa
212551 tttagattaa aaatgtcata gaatacttac acgtttttgt tccttctcta
212601 ggagaaaaac aacttgaatt gccgtggaga aaccttagac tctggtagct
212651 gtttaaactc ataaattgtc ccagaagatt tctaattccc aaaccatcaa
212701 accgtccctc acatttaatt caggaacacg ttcggcaaat gtttgtgttt
212751 gtacacgaag tctctcagcg atctaagttt gacttggaga gcaatgaggc
212801 aaaattccca tcttcctacc ccactttaac ttggagataa aacctactca
212851 agttatacat accagtactt tcaaaagccc ttcaacttat ctaagcatct
212901 ctctagcccc acactcttcc ccttttcatc tcaatatgga actttgtgta
212951 aaagcatcca aagctgaaag acagagctgt ggattatgtg cctgcagagc
213001 ttaatccctg ccaatctcac agagggcac cttacagtta ggaatgtgtg
213051 caaccagagc caggataagt tcagactcat caaacgattg ttttatcaac
213101 cacaattaca caatacaact aaaacaaaaa taaccttgag aagcaatgag
213151 taacctacaa ctcatcatga tatgaagttc aaataattgc taatgccaca
213201 cttggacagt caagtttttc aagcttcccc ctgctccccc tgcccccaaa
213251 aatagacaag attatgcaat gagaagataa aggagataga agacaatgct
213301 ccagggccag gcgtggtggc tcacacctgt aatcccagca cttagggagg
213351 cagaggcagt tggatcacga ggtcaggagt tcaagaccag cctggccaag
213401 atggtgaaag cctgtctcta ctaaaaataa aaaaaaatt agccaggcat
213451 ggtggtgggc gcctgtaatc ccagctaatt gggaggctga gacagagaat
213501 tgcttgaacc cgggaggtag aggttgcagt gagctgagat cgcactactg
213551 cactccagcg tgggcggcag agtaagactc catctcaaaa aaaaaaaaag
213601 aaagaaaaaa agaaatcaat gcttcatcct tattattcaa agctagattg
213651 caaaatatac taatctaaga aatctttagt ttttctcctc cctatagctt
213701 tagttgagct ttatgtaggg tttcttttctt ttatacaaag aagcacaaat
213751 atctctcttg gaagactaca gctcagtaac tgatgggaac atgcaagggc
213801 aggtgaaaac acacaggaca acaatataag aatgttttct gatgcacaat
213851 atgagcaaat acggttctag tcactctctt tctgctaagc aaaaaatctg
213901 acccaagcca acccctgcta tctaaaatgg tcattttga aaaatgtctt
213951 tattagtaat catttgtttt ctgtagaaat gggaataata atagctagca
214001 ttcattgagc atttaatatg tttaaagcac tattttaagt aattcgcatg
214051 tattaacaac agccctatgt ggtaggtaga gaatatcatc tttcgtttta
214101 cagaggaata caccgaggca tggagaggtt aaacaatttg cccagggtca
214151 cccagctaat aagtattaga gccagaatct gagcttggc aatccggctc
214201 cattttacac tcttgtctct gttggcagtt gaaacaaaga tgcacttaca
214251 tggacattga ttccttgcta cacacaaacc tgcaaccata tgtcaagact
214301 aacatcttat agtttatggt tacttgtaga aaccaaatta aatgaggaac
214351 ccaaacattt gattggaacc tattactgtc atcaaaaccc acttctcctt
214401 ggttttcata attcccagtg ggaagtgtat ctcagcaatt ttgtctgtca
214451 ggaattttga aaagtcaaga ggtgagtcct agtgacatta cttcagctcc
```

FIG. 7 CONT'D

```
214501 aaatcatagc acacctgaag ttggagccat ccatgaattt ttcttctttt
214551 tagttatgtg gctaaataaa ttccctttt aaaatggctg tttgagtttc
214601 aactgaaaga ctcataacag atacacccc ttctccagcc actgccatcc
214651 ccacccgcac agtgagtgtc tcacaggtgg gaccatgacc tcagccggtc
214701 tgtttattca gagtgaacct cagggctttt gtagacatgg ccagaaaaga
214751 agctctcttt ccattggact tgaacctgga aagacgtgag cctggaaata
214801 cggcatcatc taaggctgct ggagtctgct gcacagagct ggggtaatag
214851 cccatcgagg gtgaaagtgg agttaagaga agcagggaca ttgaaccctg
214901 caggcatcat ttgagtcctg aactttttag tgtcggaagc cactcaacct
214951 ccagctatct attcctgcct tacaaagacc ctaaatgtag tggcttaaaa
215001 caacaaaaat ttatgatgtc tctcagcttg gcaatctgag tgattgtctg
215051 gatttactag tcagctttac cacagtaaca aatgacttcc taaatcccag
215101 gggcttgtaa caacccatgt tcctcactct gccgttacac gtctgcgatc
215151 acatcagtga aggctctgat tctgctccat gtgttttcac gttcggggac
215201 caaggctgca ggaggagccc ccattcaagc aagacctgtc atcccttgg
215251 cagaatgaaa agagcaaaat acccgatggc cctttaaagc ctcagttcaa
215301 atacggtgta tgttatgtcc tttgataccc cattgaccaa agcaaatccc
215351 tgactttgag gactccctgt agctgtctgg gtaaattagg ttagcacccg
215401 aggccctttg tgagagttta aaataaggag atatgcacat acagagaaaa
215451 agagagaccg aggcaaagaa agagaattta tgtgtatttc tacatgcatg
215501 gtgtgtgtat gacttttttt ttttttttga gatggagttt cgctcttgtt
215551 gcccaggctg gagtgcaatg gcatgatctc agctcactgc aacctccacc
215601 tctcgggttc aagtgattct cctgcctcag ccttccaagt agctgggctt
215651 acaggcgccc atgaccacgc acagctaatt ttctgtattt ttagtagaga
215701 cggggtttta ctatgttggc caggctggtc tcgaactcct gacctcaggt
215751 ccacctgcct cggcctccca aagtgctggg attacaggca tgagccactg
215801 cacccggctg gtgtataacg ttcttaaggc aacttcattt ctgtgtggaa
215851 ggttgaaggt cagtcccaac ctgagatata ggaccagttc ttttctagtc
215901 agggagaatt caggaagcca cgttccaaaa cagtaagtca gacttctgtt
215951 gagcctgctc tgatttcaga ccttcgttct gctaacaggg atccagcctt
216001 tggccccatc tgtagagtca cagcagctct gctgctgctc atccgctggg
216051 gctactgcca attgctgctc agtcccttgc tgtcttcata gagccttggt
216101 cacaagcttc ttctcgagga caactacagg gtctgcccca ggtacatccc
216151 cacccatgag catctagttt ccacctcctt tctgcctacc agtcaggagc
216201 taagataatt ctgataatat agtaataata gcatctgtca tttattgcat
216251 atagtaataa tagcatctac catttattgc atatagtctc aaattcttat
216301 gtatcccaga agtgcagcta tttccagctg ggcctctgtt ttcattaggc
216351 atcattctta atatagatct caacccttct tcaagtcccc cagaacaatc
216401 catgaacacc aaaagtgttc acgagccatg tgtaattgac tgaggcttcc
216451 ccaaaacagt ggagtagaga tttatagggc acaccaaca gaagcagctt
216501 ttctctaatt tccttttctg ctgtgctacc atcaaggctc ctccttctcc
216551 ccacatctcg aagcttagcc ttctcagtcg tatgctgaat gcatactgaa
216601 gtaacagata atggaatatg taactacata agcttaaat aatagggttt
216651 attatctctg ggggtatcat tttcaggctt tgttaattca gggacccaac
216701 aacatcatca agcactcaac ccatgtgttt tctacttccc tctgtgccat
216751 ccccagcctg ttggttttca tcctcagagt ttccctcatg gtcacaagaa
216801 ggctgccaca gctccaggaa ttacgtccac acataactat atctaaagat
216851 aggaagagga ccattattcc tcctccccac atcataaagg aaaaactttc
216901 acagaaacat ctcagaagac ttacctttaa actcctccac tggggttggg
216951 ttacatgctc atgcctaat aataaaagtt attcagctga cacaggagaa
217001 tcgcttgaac ccaggaggtg gaggttgcag tgagctgaga ttgcgccact
217051 gcatccagcc tgggcggcag tgcatgactc cttctcaaaa aaaaaaagtt
217101 attcaggttg agtatcccaa aatgcttggg accagaagtg tttcagaatt
217151 cagatttttt tccctcccga ttttgaaata tttgcattat acttaccagt
217201 tgagcatccc taatccaaaa acccaaaacc tgaatgttct gatgagcatt
217251 tcctttgagc accatgttga cactcaaaaa atgttggatt tgaggcatt
217301 tcggatttca gattttgaga ttaagggatg ttcaaccttt attgacattt
217351 ttagcctctg gagttggaaa gtggattctg acagcaagga tgaaagatga
```

FIG. 7 CONT'D

```
217401 ggagagaatg gctgttggga agaaaaccac cagactcacc caccctgagt
217451 agcttggtgt cctactcacc tgtgtgctct gcaaagtaca acgcccaact
217501 atgactaggc catgctcttg aagcctgggt aagagccatc taacattact
217551 caggaaggcc tttagagtcc gacctctgcc ccaaccctag caaggttatt
217601 aaagccaggg atatcaaaac tccttcctta gaggagtttt actcatcttt
217651 atacctttac tgcttctcca catgcacagc aattctgcag tctgagaatt
217701 atctcatttt ttcagatatg gaagctgagt agcagagaat ttaagtgact
217751 cactcagagt cagataacta ctaaatggta gatcaatatt tgaacccagg
217801 gctctctggt tccaatgtcc ttgctgtcac tgaaagcaga acaaagaccc
217851 aaaagaaaaa gcaagaaga cagactaggc ttaaatttta gcagaagagt
217901 aaatatcttc ttggtccttt agtaacttaa aaccattaca agtttctaca
217951 gaggaatgta atttctgtcc ttggttatct ggaaaagata aaacagagcc
218001 gtgctttcag tacttggccg aggacatggg ggcattttaa agtgttggaa
218051 tgattgaaca caagccatgc tgctgagtcc tggacaccca acccttaaa
218101 tgaggcctgg ggagacattt actgaggatc tggcccctgc cccaagaaag
218151 ggggtcccag gccaaaaagc tgagtaaaca gatattttg ccacagtgtg
218201 gtaagtgcta ttatggaact atgaacaggt ctgtgagagt gtgggtgggg
218251 gagaggggcg gggagggtgg acggtagaaa aaccccctgac tgaggtcatc
218301 cctgtgttcc aggacagtgc agtcactcat tgcaaaacag ggaccctgag
218351 tcatgaggaa agagctaaag taaattcagt agacaccatt aaacaaggca
218401 ggggatggga gatgtcttgg aacgatttcc ttccaatatg gtttacagga
218451 aaacatttta gcaattctga atgtaaattt cagggggttg tttgtttgtt
218501 tttaagctta ctttatggag cattacacat ggctttatga ggattagttc
218551 ttacttcatg taatatagta agtaatttgc atacactatc tcatttaaag
218601 cttaaaataa tcctgtgaag ttgatagttc tatttttccca ctcaaaaaat
218651 tttttttta tttcggtgt ggagtggtaa ctcatgccta taattccagc
218701 actatgggag gccgtcaagg aaagatcgct tgagtccagg agtttgaacc
218751 aacttgggca ccatagtgag accccatccc tataaaaaat actaaataaa
218801 aaattaaatt ttttcaaaa attttagttg cttcccccaa cacagtgcac
218851 actattttag gtacagcaat tgatcagaga ggcaagacag cttgtccagg
218901 gtctgtcagt tcttcattgg cagagttgga atcagaccct ccctgtcatg
218951 aggccaaggt gccttctgaa aaattcactc ccagcaaaca catgatttcc
219001 tgggagaggt ggttatagct tagtatactg gatccagata gaaaataggt
219051 gttctgtgct cacagtggaa aagcaacaaa aatggtaatg aaggttgaat
219101 gatcatcagt agaaagaaac tttttttaaa aaatggataa tggacaatgc
219151 tctatcctca tatatttctg taacaaagaa ttaaggaatt caaagtttta
219201 aggagaaaag tttgtcaccc tgtatttct atagcttggg caaattgaca
219251 gacgtgctac aaaatggaag cagttaaaca acatccaatc cagaccattg
219301 ccactcagag ttcctcatcc cctggttgct tgttagaaat gcagattctt
219351 gggcccccttc caggcctact gaatcaattg aacaggaacc ccagttgatt
219401 tgcatgcaca ttaaatctga ggggcttgct gctctacata gatacctttc
219451 tctgccattg tttcgtccat tgcagataat gtcttacgag tctatgaaaa
219501 tcaaacacat gagcaggtca tgttgtgagc tgcagaagac aaatttgaca
219551 acaaagcaac atttgctatc tttttaact aagtttaatt ttaacttaat
219601 ctagtaactt cttttgaata ggttttggg aggatttgtg gtcctacaag
219651 aggagggga agataatggg gaaaagaag tcagcaggaa ggaaaaggag
219701 ggtattttcc ccaatggcgc agaccaatca tatgacaccc ttaatgtgtt
219751 atcaaatttc tacaggggtc agatgtgaag cccattacct gacatgcccg
219801 ctgggtggtc tggactttga acaatggctc ctcccatctg gaaccctctg
219851 ctattttgca aacgtttcaa tggctctgct gaaagccagg aaacaacagc
219901 tggtgaataa tctcatttta tattaataga gcagcactga cctatccagg
219951 tcccttaata cttcacgaaa cagaacatcc tttcttccc agggcaagga
220001 agggaagtct cagccatacc acattacagc atgagtaggg gccctgaaga
220051 agaatgaaca gaaagagttt tttcttgcaa acccacctca ctggactttt
220101 tcagatgagg attaagttaa gctaaaggag atggaagaga atatctgcat
220151 taaatccctg gactttacct atgcaaagaa ataaccagaa agtaagaaga
220201 ttcttgcccc agccttgcct ctgtcttctg tatgtgcagc tctttctgtg
220251 aaatcaaggt agagatgtcc aagttaagtg acaatctgaa agataaatat
```

FIG. 7 CONT'D

```
220301 ggactatttt taataccagg gctagctggt ggattaatgt tagtggagtc
220351 aaataaaaca gaatgtgaca acaccaccag ttaatgagtg tttgtgtctg
220401 tgccggtagc atttttaacg ctgtagagaa ttgcaaagga ataaggtata
220451 atctgtgatt tcaaggaact tcattttgct ggaggatttc ttcaacacaa
220501 atgactagaa gcaaggatgt aaaatataaa ctgaaagata catatcttag
220551 ccaattatac catcactgac acatacagaa aaggaagatt aaaatgtttt
220601 gattaagcaa catttctaga gattctgtca aaacttaaac aaacaaacaa
220651 aaaatcctgg aaaacagtaa tcctttcttt aacatttaca aaagttcaat
220701 tgggtattcc tgctccaatt ttctcagtgt ggaatagatg gaaagttgct
220751 agaagggagt ggttacatgc caccagagta agcaagctgg accaggcata
220801 gaaactagct gatgagaggt agggagaatg gcagaaactt cttaaaacag
220851 tagttcctaa cctttgcctt ttgtctgggt caaggactct gtgatggtta
220901 attttatgtc tcactttggc taagtgatag tgcccagatg tatatggtca
220951 aaccttattg tggacatttc tgtgagggtg ttttgggtg agactaactt
221001 ttcaattggt ggactctgag tatagcagat ggccctccct gatatgggtg
221051 ggtctcattg actccactga gggcctgaaa agaacaaaag actgactccc
221101 cctgagcaag aggggattct ctggcctgac gaccttcaga ccttaactga
221151 agccttggct cctcctggtc tccagcctgc cagcccaccc tgcaggtttg
221201 agacttgcca gcctccacag tcatgagcca attctttaaa ataaatctct
221251 ttatagacac atcctattag ttctgtttct ctggagaaca ctgactaaca
221301 cagacccttt tgtgagtttt tagaaggaat atttattgaa tgtcttctat
221351 gtgcctaatt atggactctg atcccagaaa attgcacatg aacacaaaat
221401 tttacttacg gtttccaggg aatcaccaaa cccttgaagc acatccatgg
221451 actccctccc ttcatttaaa aactcctggg cctccagcct tttatataaa
221501 ggagacgtgg ctgaatattt ccccatccaa atattcctgc tctgaaagca
221551 gttaccacct ggtgggtgaa gtaaggagtc tacctgccca cagctacaaa
221601 aggaccagga aggcgtccgg ccacataact ctctctccct cacctctctg
221651 ggaggccagg aatttctacg ttagcatcag cactctgggg tggacgtttg
221701 ttcacttaac tagaataagg cattgttact acccatggta tggctgagcc
221751 tagctggttg ttcttaagct taaacatcag cactgccttc cttgacattc
221801 tccttatctc ctcgtccttg ctgatggact gtgagtgaag gtgatgtgtg
221851 tcacctccag tcagaggcca tgcagatggg gatgcctttc atgacctttc
221901 cccgctttca ccagactcag tgaaggactt ctctgaggta ttgacagagg
221951 cctcagatgg ccaaggggcc agatcctctt tctcctgcac tccacactgg
222001 attgtgacac aagcaaaaga tcatccttta tttatgttac ttatgttaaa
222051 tgactgagat ctggaccttg tttgttagct tatcctgact aatgcataca
222101 ggaattttac cattatgaga aagacagtaa aaatattaga caaataccaa
222151 cttaaaaatt ctaatatgat ctaggctggg tgcagtggct cacgcctgta
222201 atcccaggac tttgggaggc caaggcgggt ggatcacgag gtcaggagtt
222251 cgagaccagc ctggccaaca tgctgaaagc ccgtttctac taaaaataca
222301 aaaaattagc cgggcatggt agcacgcacc tgtactccca gctaatcggg
222351 aggctaaggc aggagaatca cttgaaccca ggaggcggag gttgcagtga
222401 gccaagatcg caccactgca ctccagcctg ggtgacagag caagactctg
222451 tctcaaaaaa aaaaaaaga ttctaatatg acctaagcca ttattaccca
222501 ttgaccttag cagagactaa agcctgggtc ctgaggaagt agctatgttt
222551 aggactaaga actccaaact cagagaccgc aggagaagac taggcttctg
222601 ctggaggcag tcatgctgca caagtccagg aggctccatt cacccagatt
222651 ctgtagttcc ctggagttgt acagtgcact gcctgcacaa ctgtacaaag
222701 tagccctgct actggtagtg gcaaagcagc acaaaagagg caggaagaaa
222751 taaaagagag agaggaaggg tgacatggga gcctgctatg cctctctcat
222801 gacctcatca cccagtcaag tgctggccct gctcattgct gagatacctg
222851 aaaagtccac ccacacctca gctaatcaga ttctaggacc agccttggtt
222901 tggggggcctt tttgtctatg aaaagaagca tatctcccct gaactagttc
222951 ttgagggtct accttaaatt attggttact aaaggaaaaa tagtacaaag
223001 ggtaacctgt atgttggccc tgcagttaga aaatagggat tattattccc
223051 atttgtcaca gaaacctttt cttcttcttt tctttctttt tttctttctt
223101 tccttccttc cttccttctt ccattccttt cctttccttt cctttccttt
223151 cctttccttt cctttccttt cctttccttc tctctttctt tctttctttc
```

FIG. 7 CONT'D

```
223201 ttttttttga cagagtctgg ccttgtcgcc caggctgaag tgcagtggtg
223251 cgatcttggc tcactgcaac ctccacctcc cgggttcaag agattctctt
223301 gcctcagcct cccgaatagc tgggattaca ggtgcctgcc accacactcg
223351 gctaattttt tttttttttt tgtattttg gtagagacgg ggttaaatca
223401 tgttgcccag gctaatctcg aactcctgag cttaagtgat ccgcccacct
223451 cagcctccca agtgctggg attacaggcg tgagccacca tgcccagcca
223501 ccctcacacc cacttttaaa acactttata ttatagaaca cttcaaagat
223551 atacaaaata ggtaaaataa tgtaatggac catcattagg cttcaacaat
223601 tatcaacgtg tggaaattcc atttcatcta tttctctcta acccttattc
223651 tctcccctat tttctaccac ttttctggat tattttgaga tgcatcccag
223701 acttcatatc atttcattca tacatatttt agtatgtagc tccaaaaaaa
223751 aaaggattct gtttttttaa aaagcataac catgacgtcc ttatcacacc
223801 taagaaactt cgttaatatt gacaaatatt cagagttcaa atgtctccaa
223851 ttttctcata atttttttct acaatttgtt taaattagta ttcaaacatg
223901 attcacacct gcagttggct aatatgtcta ctggctctct tttcagtaac
223951 aagctgccct gtcttctttt cttttctttt cttttttttc ttccaattta
224001 tttgttggag aaactgggcc atttgtcctg ttgagtttcc cacattctga
224051 attttgctga ttgcatccct gtggtgtcat tccacctgtt tccctaagcc
224101 ctgtatttcc tgaaaagtgt ctgctagatc tacagccttg aacaattcca
224151 gcttgatatt ttgacaaggt tatttcatag gtggtgttgc gagcttttgc
224201 atctcatcag gggcacatgt ctgcttccct cccatttttg taatgttaag
224251 attaattaga ggattcgggt attgccagct tagtccatcc attagagagt
224301 tccccatcag catttcccct aatagtttta acagccattg atgaccagtg
224351 cttggataca ttatttctat gattgcaaaa ttatggtatt ctaattctat
224401 cattcctcct tcatctatta gctgaaatgc ttctaaaaga agacctttcc
224451 ctcaacaaca atttagttac cctgaaatac agttcatata caaaagacaa
224501 atgctcaatt cttttccttt ttaaatcagt tttcagagta atgagttggt
224551 tccctagcaa cccgtaaagg tgacctatga gaattttttt tctggtataa
224601 ttataaactc atggatttta acatatttga tgtatttcaa tccagtgtgg
224651 atgcttgaat tattccatct ttgaacagtg agtttctttc tattggttcc
224701 taacctaagc atttaggaca caaccaagtc atctctgaaa gcttcgttac
224751 tttccagcat gtcaaaatgt ctatttctttt tcttttcttt cttttttgaga
224801 gagagagaca gagagtctcc ctctgtcatc caggctggag tgcagtgaca
224851 caatctcagc tcactgcaac ctccgcctcc tgggcagaag caatcctcct
224901 gccttagcct cccaagtagc tgggactata ggcacttacc accatgccca
224951 gctaattttt gcagttcttt tttttttttt tttgagacgg agtctccctc
225001 tgttgcccag gctggagtgc agtggtgcag tctcggctca ctgcaagctt
225051 gggctcactg caagctccgc ctcccagttt cacaccattc tcctgcctca
225101 gcctcccgag tagctgggac tacaggcgcc caccaccatg accggctaat
225151 ttttttgtat tttagtaga acggggttt cacggtgtta gccaggatgg
225201 tctcaatctc ctgacctcgt gatccgcccg cctcggcctc ccagtgcagt
225251 tctttttttg tagagacagg gttcgccac gtttcccagg ccggtctcaa
225301 actctggggc tcaagcaatc cgcctacctt agcctcccag tgttttgatt
225351 atgggcgtga gccaccaggc ccggccaaa atgtccgttt cttgcctcag
225401 ctctggaatc agtgattatc caaggacgcc ctggttccct ttagtgacaa
225451 attggattta gaaaccacag tcacagagct ggccacctcc ctacctagga
225501 gccctctccc tcaggtccct cacatcttca tttgatccta cttttttttcc
225551 ccaatccttg actgtcccag cttttccaca agggaacaaa agattaatag
225601 ctaaaggaaa ctcatgatat agtcatgtgt cacctaataa cagagatgtg
225651 ttctgagata tgcatcatta ggagttttcg tcattgtatg aaccccgtca
225701 tgttctcaca caaacctaga ttgtacagca tgctgcatgc ctaggctaat
225751 gctataacct atccctccta ggtcacaaac ctgtacagca tattactgta
225801 ctgaatattg taggcaattg tagcacaatc gtacgtgtat gtctatctaa
225851 acatatctaa atatagaaaa ggtggctggg tgcagtggct catgcctgta
225901 atcccagcac tttgggaggc cgagacgggc ggatcacaag gtcaagaaat
225951 caagaccagc ctggccaaca tggtgaaacc cgtctctact aaaaatacaa
226001 aaattagctg ggcgtgatgg catgcgcctg tagtcccagc tactagggag
226051 gctgaggcag gaggatcact tgaacccagg aggcagaggt tgcagtgagc
```

```
226101 tgagattgca ccactgcact ccagcctggg taacaagagc aaaattccga
226151 aaaaaaaatt aatttaaaaa accgaaagaa agaaaaggta cggtaaaaat
226201 tcagtgttat aatttcatga gatcactctc ctatatgcgg tccatcattg
226251 actgaaatgt ctttatgagg tgcacgactg taactgaaaa cagttatcac
226301 cttgatacag gtgaagattg agacaaatct cttctttagt ggaacgtgtc
226351 taattccctc acatgaatag cctacactct ttcccttggt tataagggct
226401 ccaaaactac tgagtcccca aaaccaagga ggtaggggt tgagggacat
226451 ttacctttgc ctaatgaagg tttttttttt ttttgagac ggagtcttgc
226501 tctgtcgccc aggctagagt gcagtggcgc gatcttggct cactgcaagc
226551 tctgcctccc gggttcatgc cattctcctg cctcagcctc ccaagtagct
226601 gggattacag gctcccgcca ccatgcctgg ctaattttt aaatattttt
226651 agtagagacg gggtttcacc gtgttagcca ggatggtctc ggtctcctga
226701 ccacgtgatc tgcccgcctt ggcctcccaa agtgctggga ttacaggcgt
226751 gagccactgc gcccggcctg aagttttata tataatacaa ggagagcgca
226801 tcctttctct acaggtgtct tttgcactct ggtaatcaaa cagttgtttg
226851 attgtatggt ttctcatcaa gcattttac ccttcaagtt ttatctataa
226901 gtctagtgta agactggggg atatttctaa gttgtggttt gatgagtccc
226951 tgacttcaaa cccaactggt acatcacaaa ataacaatgc tctgtagtca
227001 ccaaaatctt tagatctacc tgaatggatg tggacctatc tcctagatag
227051 attaggtgga aaacagtatt tattacatta tcatttgtgt aaaagggaaa
227101 aagagcttga atatgcacag aacatgtttg aatctataac agattggtat
227151 agagatagaa aggagactca catttcacca tataccttt ggttgtagtt
227201 ttggcatttt aataatgtgc acgaatcatc tattcaaaaa atttatttta
227251 aaaaacctga agaaagcact ttagtagaga atcaatactg tctgattgat
227301 tgattgatcg gcctcagctt tccaaggagt tattgtagat ggaaagtgaa
227351 gaagggtatg cttttacagg agtatattta tgtcttaggg aaggcttgaa
227401 agccagaggg gatgacgata aagagagttt gaacagatac ccagaaacaa
227451 ctgcacttga aagaacttgt gaaatgctta agttctctga cacttagaga
227501 attataccct agctgtgata ccattatgag atgtgagagt gtgcttgttt
227551 agaaagcacc ggaacttgac ttcaggttct ggagccagcc aaagagtctc
227601 ctctctctgt ctggaagggt tgtgtcaaat tcatgcacat tctcaacaat
227651 gactgtcttt ttctaatggg ggatggggag aaagggcaaa tattcaaagc
227701 caggcaaagg tgggggcgga gtcaggaggc ttttggactt tgacacctta
227751 tctctgtttt tgccatctta ctggggagtg gggaacagag aagagcttgg
227801 tttattctca gggaaatgtc tggagactgc cccatggcct caggtcaccc
227851 tgaatttagg atttagttct aataaaattt tattctggga tgcaacctcc
227901 ctctagttgt taagacttct ggttgtccag tctagaatcc atatgaaagc
227951 caagcttacc atattaaagc caagcttacc aatgacttcc aataaaaaga
228001 gcttagaatg gaagaaaaga gataaagaga aaaagagaaa gatgatcttt
228051 agttaaagcc aaatcactga tcacttatgg caggcccttc actttatctc
228101 tcctttcatc caccttccct atcaacagca cttctagtga ggtggcattt
228151 tggagtggga aagacctagg tttgaatccc agctctgcca tattagtgga
228201 ataacctcgg gcaaattaca taaatgctct gaaccaatgt cctctttggt
228251 aatgtgggac actggtggct actttagtct taagttagga tcaagtgaga
228301 gcatttatac aatacaataa gcatttttg agtgcctatc atgtgatagt
228351 gagatagaag accagcagaa cttgctttct ggtcacaatc ccgctgacca
228401 aaacagaatc tagtccagac aagataaagt gaagagcctg gccaaaacca
228451 gcagatggtg acaaaagcaa tccctagctg ccctcattgc tcattagcat
228501 aagacactcc caccagtgcc gtgacaagtt acaaatgcca tgccaacaac
228551 cccgaagtta ccaccctttt ctctggcaat gccccagaag tcactgactc
228601 tttcctagaa agctttaaat aacccacccc tcaatttgca ttaaccctcc
228651 ccttaatttt tcaaatagtt gaaagtgaat ataagtgagt ataagtacag
228701 ttgctgacag cccataccct gctgattcta ggcgcactgc ctgtgagtta
228751 gccctgctcc acaagaagca gtactgttca ggaaaaggtt gctgtctaaa
228801 accactggct tgcccttgaa ttctttcctg ggcaaagcca agaacccttc
228851 tgggctaagc ctcaatcttg gggctcacct gttctgcatc atctggtggc
228901 cacaaaggga tgaagatagt gagtgggagg aagtgaccaa tgtggcgtcg
228951 agacagcaga aatggcagtc atcagcggca agatggcaag acaatagcaa
```

FIG. 7 CONT'D

```
229001 ttagcaaaga ggccaaatga taagaaatac ttgagagatg gagaaatggt
229051 gagacagcaa gatggcaaga cagtgaccag tgagatggtg agaggcggca
229101 atcagagaga ggtggtgatg tggcagtcag tcagtgctgt aaggatcaaa
229151 gctgcagaga gctggaacac taaccaaagg ttcttttcag gaccatcatc
229201 tttcctggca gatggttgag ctgagtggat aggtgagtag ccatagtgca
229251 gggattcaaa gctctggctg ggaggctgca ggatcacatg ccaattccct
229301 cgcagcaacc aagcctgccc aagccgggga aacctgggga gcaaaccttc
229351 acctgcactg tacatcagag accagttggc cctatttttgg ctcctgtgga
229401 caggtaagta tccctttttga ctcatccccc aaatatcagg tgagccagga
229451 aaataaggcc tttggcttag acagtcaatt caaagtctgc catagcatcc
229501 ctaattacat ccctattgcc ccttttctag gtcgtttctc ctctaacacg
229551 attttatttt tctgtcagcc attttatttt atttctcacc ttgaaatata
229601 tgttttcttt gcagttttttg ctttggcttc ctgctaactc tatttgggca
229651 attgtttaag gctgaacact tggttatgag aggtaccctg ttgtgttgac
229701 cctgggatgc cagagtcatg ttgttctgtg gccccaactt ggtctttggc
229751 cgcccccctgg atgctctggg attttttggca ttgggtgtgg ggactctcat
229801 tggccactac tcggttactg tgggttttca gcatttggta ttgttggccg
229851 ccccaggcac tcccgggttt ttggcattgg cattcactag gattgtgggg
229901 taggagccta cctaagggga atcttggtct tgccttttct catttctac
229951 cctaaagtta tcgtttccca taacagcatt tccttttgtt attgccactt
230001 tatttacact tttcccacta taacttgctt aatgaaaata cttcttttgt
230051 cacatttcat tcactttata agccactttc ataacacgtt gctacctata
230101 cttactcctt ctctgcagga agtggaaatt ggaaaggaaa atagaaaggg
230151 ccccgttgct ttccctctca ctagactcag aagaacttct atgtccagta
230201 gaaatcatcg ttagacatgg agacaatgat aagcatacct gaggactcac
230251 cgttaggatg cctttcaggc tattggagca aattcaattt tggcttaaag
230301 aaaaagaaac tcatttccta ttgcaacacc acttgggtcc aatacaaatg
230351 agaagaccaa gacatttagc ctaaacatgg ttctatgcat tataatgcta
230401 ttttacaatt aacattaaaa agaaggaaaa tgggacgagg tcccttatgt
230451 acaggctttt atggcccttt actgactcaa tgttacttca aggcaccagg
230501 aagccacgcc taagggatcc cctcctagct gcttctctta gaaggcctac
230551 tccctcccca gagcctcctc agtctcccaa tttggagggg ttcctgccag
230601 ttctctaaca caggactcca cccaaggtca tcaggcactc ctccctgtta
230651 ttcagctagc cccagcctaa accctctgct gtcggaaaaa gtagcccaac
230701 cagtatccct agaaatgggg ctccatatca gcccctgaag tcaaagctgt
230751 gtccattgtg ggaggtagtt gatggagatg ggggacact tagaatacac
230801 atgccatttt ctatgtctga tttggctcta tgcaaggaaa aattctgcca
230851 gttttcagag aattcattaa agtttataga agagtttgtt aaaattgacca
230901 tgttctttag cttggtatga cttgcaagca ttgttgccca cttgctatgc
230951 catagagaaa aagcagagga aagtgtgtgg ctaagcctct cagttatgaa
231001 aaggttagag atgtaattca gggtaaagat gaaatctca ctctttctgg
231051 gtagtttggt ggaggaactc aagaaatata ctaatacaga ctcagactgc
231101 ctggaagggc aagctctcct gggtaggcat tttattattc aatttgctct
231151 gacattagga ggaagctaca caaagtagca gtgagacctc aatccgctat
231201 gaaccaagcc ttaaacatgg cctttaaaat ttataacaat agagacaggg
231251 caaaaatgga aaagaccaaa agaaataacc aaaagaaca attattggtg
231301 atgctgtaag caccccttcaa cctcagggtt acccatcccc agaaagtgtc
231351 tcgacattgg tgtctgggat acctagacaa gagccccaac ttgctagccc
231401 ccaggacaga atcagtatgc ctactataag caaaagggta atcagcaata
231451 agaatgtctt aatcatccct cctgagatga aaagctccc tgtccatgtt
231501 agaactaacc ttcttccact agcccaaca agctgccttg ctcaagtaag
231551 ccagagcttt gaaaccctgc gctatggctg ctcatctatc cactcagctc
231601 caccatctgc caggaaagat gatggtcctg aaaagaacct ttggatcaaa
231651 tcccggaccc ttgatccaat ggttagcttc ccacagtggc agacaagtag
231701 ccacccaaac attcttcttc cgtgtctctg ctgctgggtg acctctctag
231751 cagctcaggg actctgaggt ctccccttta gcaatgggct ttgccccttc
231801 ctttccttat ttgatgctac aagatcccct tccctgcctc ttcctgtctt
231851 ccatacctat tggagcaaac gatatttggc caggtagaca ggtcccaatt
```

```
231901 ttgtaaataa cagatccagc tgtcttgtat aggtcacttc atttgtgtga
231951 tgtgtgttgt gtctagcatg ctatcaaatt ggttcatagg ctgggcacag
232001 tggctcaggc ctgtaatccc agcattttag gaggctgagg caggtggatt
232051 acctcagatc aggagttcga gaccagcctg gccaacatgg tgaaacctca
232101 cctctactaa aagcacggaa attagctggg tgtggtggcg tgcacctgta
232151 atcccagcta ctctggaggc tgaggcagga gaatcacttg aacctgggag
232201 gcagaggttc cagtgagcag agatcatccc gttgcactcc agcctgggga
232251 acaagagtga aactccatct cggaaacaaa aataagacaa aacaaaacaa
232301 aacaaaacca aaacattggc ttataaataa aagagcactc ataaattaaa
232351 caaataggac taaatttgtt agtttgaagg gaatattgtg acttctaaaa
232401 tttaacttta agcttttta ttagataaaa tactaatttt cataggcttt
232451 agaatggtta aaatggcttt aaatgttgaa cttttgtgt agtttaaaat
232501 cttaagattg gctgggcatg gtggctaaca cctgtaatcc cagcactttg
232551 ggaggccaac gcaggcagat tgcttgagca ggagtttgag accagcctga
232601 gtaacatgat gaaatcccat ctctacaaaa aatacaaaaa ttagctggat
232651 atggtggcat gcacctgtaa tcccagatac ttgggaggct gacatgggag
232701 gatcgcttga gcccaggaag tggagattgc agtgagctga gactgtacca
232751 ctccacccca gcctgggtga cagtgagacc ctgtctcaaa atcaatcaat
232801 caatcaatca atcaatcaat caatcaatct taaaattata gagtggttct
232851 catctataga atgtcaatat ctgatagttc aggattcttt gctttctaaa
232901 tttatatata atgtaccagg gaagatatat attctttatt gtgaaaaaga
232951 ataacttgtt caattcagaa attattaaaa gggaggttca aaatataaag
233001 gaatctgcga ataaaaaaga gagatatgtg gtgagttatg gatagaagac
233051 tttttttttt tggtggggtg gaatatatat attttaaat gatcttgtgt
233101 aacgagaaat cttgtgtggt agattcttgt actagaataa agtcactggt
233151 gtttgggagg gaggtgacgt aggatgggtc agagggtcca gacatgtcat
233201 ggacggtctg tgtgggctgt gagggggctca tgaaggggaa tttgtgaggg
233251 gagttaagtg tttgactaag ctggctatga ttgatgggaa attgtttgtg
233301 gtagactttc tagaaaatga tctatgtgcc aagcgcagtg gctgacacct
233351 gtaatgccag tactttggga ggccaaggtg ggcagatcac ctgaggtcag
233401 gagttccaga ccagcctggc caatatggtg aaaccccgta tctactaaaa
233451 acacaaaaat tagctgggcg tggtggtgtg agcctgtaat cccagctact
233501 cgggagactg aggaggagaa tcgcttgaac caggaaggca gaggttcgag
233551 cagtgagcca agatcgtgcc attgcactcc agcctgtgtg acaagagtaa
233601 gactctgtct caagaaaagg aaaagaaaaa aaaaaaaaa agcctatgtg
233651 ttgaaactgg gttttcttta ggtgttcatt tgctaaatta ccagaacttt
233701 tgcttttcca ttctgtgata tatttctttt gaaagctttt caaatttgtg
233751 taactctctc cttcagcttt tcatcagct cctgtgactt tttctcctgc
233801 agttctgaca gttgctgtga tctgatgcta aagtgttttc ttagaggtct
233851 gcgggaccag tgttttcct gaatacagct taattctatg ctcgtggttt
233901 tccttgaata taacttatt tttggctttt agttttgac tctcttttc
233951 ttttctttt tttttttttt gagacggagt ctcactttgt caccaggctg
234001 gagtacagtg gcttgatctc ggctcactgc aatctctgac tccctggttc
234051 aagcaattct cctgcctcag cctcccgagt agctgggatt acatgcgcat
234101 gccaccacgc ccggctaatt tttgtatttt tagtagagat ggggtttcac
234151 catgttgatc aggatggtct caatctcctg acctcgtgat ccacccgcct
234201 cggcctccca aagtgctggg attacaggag tgaaccacca cgcctggcca
234251 gttttgact cttatattgc ttaaagggc tttgagggct aatgaataca
234301 tgcccacctc cacttctatc tggcctagaa tgtttaattg gctacaagtc
234351 attggactct aagtctgctg ccaaagaga atccctcccc ctgccaaaaa
234401 aatggaaaaa gtaactcagg ccatgacagg aaacagggag tcagctgcct
234451 cactatgcct ttcccttgga atttaggcca ggttcaaaag gtctttaaaa
234501 attttgaaaa taaagtattg gccttttccca cagagaaaaa taaatagctc
234551 ctcggttcaa tcagaagact tagtgttact aaaaacttca aaaaagatc
234601 ccctgatcat cagttaaaac caaaatggaa gggccccttc aggtattgat
234651 aaatactgtc actgctgtta agcttcagag agtcactagc tgtgtacacc
234701 tgtccaggat taaacctgtg tcttatgagt tccccatggg cataaaagga
234751 gcacaccaca acctacattt atgaacctag aaacttaagg ctgttgtttt
```

FIG. 7 CONT'D

```
234801 gcaagcacat agataaataa caggatgctg tgggtggggg taggagcatt
234851 aattttttctc ttcctcctaa ttgtaatttt cttgtttagc ctccctcgta
234901 aactttgtat cttctagatt ccacataaag atgatgccag cacaaggctt
234951 ccaactcatc cggtctttgg acctggaaaa gaaaaacatc ctgccattgg
235001 gcctcttagg tcaggtatcc agagactttt acactgccaa tactaggcgg
235051 ggtctatgcc cataaaatca gcaagaagta gttacagaag atggaccttc
235101 accctctgc agcccctta agattaggag ctttggcca gacacagtgg
235151 ctcatgcctg taatcccagc actttgggag gctgaggcag gtggatcaac
235201 tgaggccagg agttcgagac cagcctggcc aagatggcaa acccccatct
235251 ctactaaaag tacaaaaatc agccgggtgt agtggtgctc gcctgtaatc
235301 ccagctactt gggaggctga ggcaggagaa ttgcttgaac ccaggaggca
235351 gaggttgcag tgagccgaga ttgtaccact gcactccagc ctgggcaaca
235401 agagcaaaac tccatctcaa aaaaaaaaaa aaaaaaaaaa tcaggaagtg
235451 tatctaatttt ctaaggggga agtgaggtag gagactgata ggacttgttt
235501 tctggtcaca accctgctga cgaaaatagg atctagttca gacaggataa
235551 tgtgaagaaa ctggccaaaa ccagcagatg gcaacaaaag tgctccctac
235601 ctgccctcct tgcttattag tgtgagacac tcccactagt gccatgacag
235651 tttataaata ccatggcaat gacccagaag ttaccatccc tttccaagaa
235701 gttctaaata acccatctca ttttgcatta accttttcctt aatttgcata
235751 tacttaaaag tgggcataag tgagtataaa tacagttttcc aagtgcccat
235801 atgttgctga ctctgggtgc actgcctatg aattcgccct gctctgcaag
235851 aagcagtacc attcaataaa agattgctgt ctaacaccac cagctcatct
235901 ttgaattttt tcctgggtga ggtcaataat tctccaaggc taagccccag
235951 tctaggggct gtttggtgga tcattgagcc cagcagtttg acaccagcat
236001 ggaccacatg gcgaagcccc atctctacaa aaaaaataca aaaactagcc
236051 aagtgtggtg gtgcatgcct gtagtcccag ctacttggga ggctgaggca
236101 ggaggatcac ctgactacag gagggtcgaa gctgcagtga gccatgatcg
236151 tgccactgca ctccagcctg ggcgacggag tgagatgctg tctcaaaaaa
236201 aaaaaaaaaa aaaaagtgg ccggcaggg tggctcaaac ctgtaatccc
236251 aggactttgg gaggctgagg cgggcagatc acctgaggtt agggttcaag
236301 accagcctgg ccaacatgac taaacccat ctctactaaa agtacaaaaa
236351 ttagccgggc gtggtaacat gtgcctgtaa tctcagctat tcaggaggtt
236401 gaggcaggag aattgcttga acccggtgg tggaggttgc agtgagccta
236451 tatcgtttca ttgcactcca gcctgggcaa caagagcgag actccatctc
236501 aaaaacaaac aaaaaaaaaa aaaaaaaaaa aaaaaaaaaa aggaaaagaa
236551 aaaatggat aagggaatcc ttgtgctaaa gggtgtcaga gacaatctga
236601 gaggtaaatg ctacgctatg gactaacagt aaggggaaaa gaagatggta
236651 aatttgcaga gaagatcaag tttgatcagt ttcctggcct gaaggtagga
236701 caatgacaaa ggctcatttt aggggcttct ggtatacaaa ggtgtagggg
236751 cactacaaaa aagtcattct gacacttgtt gaaatgctat aaggaagact
236801 ttatttaaga ctattgcaat aggagagaga gatcaggctc aactctgaac
236851 acagcttgga caaatggata cttatagtca aggagcagag tgacggggtt
236901 ggtgggtgaa aaattactag gaggagacat caagggtaga gagattcttg
236951 ctaaactgaa ctagcaggat tctcactgaa ggaaagccaa ggacttagac
237001 atcaaaggtg gaggatgagg aacttgctca ggtatcagtg gtgatcagac
237051 cacaaaatgg agggaattct ccctaaactg acttagcaat attcttgttc
237101 atactgggct aggcaggcca aagacaggac aggtgccaag gtcttagtgg
237151 agtctaagtg gagaagaagg ctcagaggag catgagtcag gtttggtcaa
237201 ggagagggtc tttgttggag ggggaaatta aatggtgtgg agggggaattt
237251 tagatggttc aacaaggagg caatgtagtg agtggcagca tgggagaact
237301 gaggctggag aagttctcag cccatgctgt tgccctgtt ttgccccttc
237351 cctccctctc tcccacagga gcagttgact ggctgcctct tgctgtggtt
237401 cctgtgaaag gcggctttag tttggatctt cagtggggta aggggctctt
237451 gttcagaata gaggcttcca aatatgcatg aacggaagta acacaagcaa
237501 aatgcatggg acacagtagg tgtgcaatgc ctatgggtcc tcttctcttt
237551 ctcccactgc tcccttttca gtgatgggcc cagaaaagct atagttctat
237601 accctgtaca catgctcgtc tctcactttg aggaagaaca attcccccaa
237651 acactttttaa aaaaacagta acatctagca ataaattaac aactggcaat
```

FIG. 7 CONT'D

```
237701 gaactgtttc ctgcaattta aattgtttct gaatgcagtg tcattaggtc
237751 ctggctgtag gctcttaggg actgcacacc tggaaggctg ctgggcagaa
237801 gtgtcataac ccatacccc agctcttcct tctctcaagt gtcacaatcg
237851 ttttgaacta tttggaattt ccacctattc ccccaaattg gcagcctctc
237901 ctgacttta tagcttttga attttgtaca aagtgcatgt gttaactatt
237951 taaattttta tattttcaaa aaacgatgat ctctgttaca gcagctaaag
238001 tggatttcc ccaccccagt aactcaccac atttccctat tttatcttct
238051 tagtagtact tgccagcata ttgtttttat actgtgccca gtctccctcc
238101 actaaaccat aatctcctcc agccaatact ctgacttgtt ctctatgaaa
238151 tctctaatat ctagagtatt tattttcctt cctttctct tctcttcttt
238201 ctttttttc tgttagtatc ttatttagat ttgtagattg agatgccttc
238251 atacaatgtt ttagagattt ttagtggttt ttttcctata gcctgaaaga
238301 gtttacataa cagaaattat ctattcataa agcaatgcta ctcaaaatgt
238351 gttctgcagg cactaaagta taaatcaaac atactattta gctcgaatgt
238401 actatttagc tgagttttgt ttttgtttt ttagcaaaga ctttgttgat
238451 gaaggaagca atatactgat ttatgttcca gtgcaagctc cttaactttt
238501 tgcgggctgg tagcaaacag ttctgtaacc agctgagtag cactgcggta
238551 aagggtaaca gaatacagat acaaaaccac cagagactgg tgcttttca
238601 actgttagat ttaaattgcc tttctagtct cttccgtggg cattgatctg
238651 tttagatttt cttcctttac ttggctcaat tttgctaagt tatatttac
238701 tagaaagcta tcaatttcct ctattttcag atacatttct agagttgcac
238751 agaatagttt cttttagttc tctttatctc ttccatatct gttttggatc
238801 ctcaggagta aatagaggaa catgcagtaa aaaaagattg agaaaagatg
238851 caaaaagatt agagtgcaac caggaaaggt cagtattatt ctagtcactg
238901 gagatgcaaa aatatgcaaa ttctcgaggg gcttcatatt ttatctcttt
238951 taattatcct gaaatagttt tattattaat tgcttttga agaagtagat
239001 attgccatt aaattatcta cttagagact ggtcagagtt tcatgttctt
239051 tttttgttac ttgttttgtt tcaaaattt ttatttaatt attttattt
239101 ttattttaca ggtgcccacc accatgccca gctaattttt gtatttttag
239151 tagagacggg gtttcaccat attggtcaga ctggtctcaa actcctgacc
239201 accaggtgat ccacccgcct cagcctccca aagtgctggg attacaggcg
239251 tgagccactg cacccagcct tcattgttat atgttcatta tatcacttat
239301 aatgtattat gtttataaca tataatgttt gtaagtatta ttgataggtt
239351 tggctgtgtc ctcacccaaa tctcatcttg aactgtaggt ctcataattt
239401 ccacatgtca tgggagggag ggggactcag tgggaggtaa ttgaatcacg
239451 ggggcgggtt ttcccatgct gttctagtga tagtgaataa gtctcataag
239501 atctgacggt tttacaaagg gcagttctcc tacacatgct ctcttgcctg
239551 ccaccatgta agacgtgcct ttgcttctcc ttcaccttcc accatgattg
239601 tgaggcctcc ccagccatgt agaacggtga gattaaacct cctttctttt
239651 ataaattacc cagtctgggg tatttcttca tagcagtgtg agaaccgact
239701 aatacaatta tgttcttgat gttcattcaa gtataaaaag tgcatcccctt
239751 tgggttctca tcctatttct gccactgact gctaagtgat cctgggcaag
239801 ttcctcaggc tctctgaacc ttataagctg caagattgag aggttgctct
239851 agataacaat agctaaaatt tatcaactgc ttactgtgta ctaaatactg
239901 acctaagtgc tttacatgaa taatttcatt taatctctat gaattaggta
239951 ctattatttc tttcatttta cagatgagga aactgaggcc cagaaaactt
240001 gctgatgttt cctgaaaaaa tagaatctaa gtcaatgctc ttgggaggtg
240051 caattctagg gatgtgggag tgaggggtag ggggagtgag gcagggaaga
240101 tgggaagcaa atgcaaggcg atgagtttcc acactggcta ccactttact
240151 gtgagccatg aagcagcaca cctggtctca tggcaggaat ggcttcttgg
240201 ccttagggaa cactggctgc gtggaaaaac cacacctcag aatgatccat
240251 gggagaggaa aggggagagg gagtttgctg ccatctctcc cctgtctctt
240301 gtctctactg gcccaagttt gtcccatagg gagtcgagaa tgccttcctc
240351 ctgggtggtg tcatgcagcc tcttagcag gcgctgggga agttagttcc
240401 caggccttgt gggttggctg ttcatctgag tctggaagtg gttggaggag
240451 ccataacccc agatagggag caggtgtgtg ggccacacac agtagctgag
240501 gcaaacagg cagctgagga ggcagataag gctgagagaa gtctgatatt
240551 catggatggg tgtggtgagt agtcattgaa atgcagacaa ctgggctggg
```

FIG. 7 CONT'D

```
240601 catggtggcc cacacctgta atcccagcac tttaggaggc cgaggcaagc
240651 ggatcacttg aggtcaagag ttcgcaacca gcctgggcaa catggtgaaa
240701 cctcatctct actaaaaatg caaaaattag cctggcatgg tggcgtgcgc
240751 ctgtaatccc actactcagg aggctgaggc aggaaaatca cttgaaccca
240801 ggaggaggag gctgcagtga gccaagatca agccactgcc ctccagcctg
240851 ggcaacagag caaggctcca tctcaaaaaa aaaaaaaaaa aaaaattgca
240901 gacaactgga ctctagggcc agaccactag caatatgctg cacatctctg
240951 agagcccctta ggtatagaaa aaatattatt attatttttt gagacaggat
241001 ctcactttgt tgcccaggcg gagtgcagtg gtacgatcac agctcactgc
241051 agcttcgacc tctgggctca agtggactac aggcatgtac cagcatgcct
241101 ggctgatctt tttaattttt tgtagtgatg gagtcttgct atattttcca
241151 gggtggtctc gaactcctga gttcaagcga tcttcctgtc tcagccttcc
241201 aaagtgttgg aattacaggt gtgagtcact gtgcctgcca gaagaatgtt
241251 tatggtcagg tacatacagg cccagtcctt gttttctcag tgttcaagtc
241301 ttcaataata atatcccctc tgttatcttc ctagtgaaat cctattcctt
241351 tctcaaatcc tatttggata acaattatc tccaagcctt taagactcaa
241401 tcactccatt ctctcaattg ttttggcacc ttgtgcatat ttctcttctt
241451 gcatacatga tatttattgt agcctatatt agagcaggct gtatgtttac
241501 taacggcagg aacccctattg tgttttcaga tcctgtaacc catgtctgcc
241551 tagagagagc ctttggtatg tgcctgcaga gctgaatgat agacaatttt
241601 acatttgtgg ccaggtgcag tggtttacgc ttataatccc agcgctttgg
241651 gaggctgagg tgggcggatc tcctgaggtc aggagtttga gaccaacctg
241701 gccgacatga caaaacccca tctctactaa aaatacaaag attagccggg
241751 tgttgttgtg ggagcctgta atcccagcta ctggggaggc tgaggtgggg
241801 agaatcactt gaacccagga ggtggaggtt gcggtgagct gaaatcacgt
241851 cactgcactc ctgcctgagt gacagagcga gactctgtct caaaaaaaaa
241901 aaaaaatta catttgtgta ggtttaaaaa aaaagttta aattttagaa
241951 cagttttaga tttacagaaa aattgcaaag atagcacaaa gagttcctat
242001 gtgctctgca cccagtgccc gtatgattcg tatctaacat tagtatggca
242051 catttggcac aattcataag ccaatatttg tacattataa ttaattaaag
242101 tccacactaa gtcaggtttt cttggttttt acctaatgtc ctttcttctg
242151 ttccaggatc ccacactaca tttacttgcc atgtctcctg agacccctct
242201 tggctgtgat ggtttctcag actttccttc tgtttaatga tcttgatagt
242251 tttgagtaat gctggttagg catttgtag ggtgttcttc aattgtgatt
242301 tttctgatgt tcttgttctg atttgactgg ggttgatctg gggagtaaga
242351 ccagatagtt aaagtgccac tggggtcaca tcctatcaag ggtacgtact
242401 gtcaatatca cttaccatga tgatgttgac cttgatcacc tggctgaggt
242451 agtgtctgtc aggtttctcc actgtaaagt tgctcatttt cccccttttcc
242501 atattgtagg ctttggaaga aagtcactgt gtgcagccca catttttagga
242551 atggtggttt atattctatt tcctttaggg tggagtatca acatacattg
242601 tttggtattc ttctgccctg gggattcgtc tatcctttcc catgtattca
242651 gccatttatt tatatcagta tggactcatg gatatttgct ttatactttg
242701 ggtcatcatc tagtactgct tcattttatt ttgttttaat ttttgagatg
242751 gagtctcgct ctgtcaccca cgctggagtg cagtggcaca atctcggctc
242801 actgcaacct ctgcctccca gggtcaagcg attctcctgc ctcaacctcc
242851 tgagtagctg ggactacagg tgcatgccac catgcctggc taattttgt
242901 atttttagaa gagacagggt ttcgccatgt tggccaggca ggtcttgaac
242951 tcctgacctc aggtaatcca cccatcttgg tctcccaaag tgcgggatt
243001 acaggcgtga gtcactgcac ccggcctagt actgctttat tttgttgctc
243051 aaatgttccc agctctggcc attgggagct ctgtcagttg gtttctgtgt
243101 ccctttggca tacccaatc attgtggggg gtttgggtt tgtttgggtt
243151 ttttaacact ttattacttt ctggcactaa agatgttcca ggctcacctt
243201 gtgtatttcc tgacccagtc ctagagtcag ccatttctcc aataagactt
243251 agttcctttt cgtgaagaat ggtattacaa accaagagct gggctctagg
243301 tgtgtcatta ccactggggt gtcattaatt ccaggccctc tcagctgaca
243351 gagcaggaaa atatatgtgt gtgtaatagt caggaaggtt cctttaatct
243401 tacaaagcac actttgaaaa attggaccaa tttagagttc tctggctgct
243451 cagtctcaat ctctttttgtt ttcctttttcc cagtgcctgt tcctttgtgc
```

FIG. 7 CONT'D

```
243501 aagtccagac cggtttgtcc tcgcatccct tccttgccct tcctctgctc
243551 cacggcctcc tgcagggagc tgatccctga cgtctcctag gttcccaggt
243601 cagctggctg ctggctggac tctggccagg ccagcggtgc accagttgga
243651 ggtgggggca gcacttccag atgcagctcc agggcctgct ggacaggccc
243701 cctgtgattc tgccttcttc taggctgtag tgacatcacc cctgtccttt
243751 gtccctcctg cctggaggtg tcaatgactt ctgactgggg tctccctgcc
243801 cctcatgggc ttctcaactt cttctgtcac atatgtaacc atttctctga
243851 ataaattccc tttgttaaa acagtgctac ctacttcccc ggtgggcctt
243901 ggacagaact gtcggtaggg agtttcatta ggaagggact ccaggaatgg
243951 cagtggtgtc tgagtaaaag caggatggag ggagagtgag tccaaggcag
244001 tattctcaag ccagtcactg ctgtgggccc taggaagcca ccccactggg
244051 gactctgagt cactggggag aacagccctc agcattgtct gacagcccca
244101 actgctcgag acgtgcccaa aggtgaggaa ctccctagta cttccaggtt
244151 ttcacacaaa tctgaatggc tcaatgggac cccacaggga tccccaggcc
244201 ccgatagatg ctagagattc gacaggaggc tgagggaggg gatggatggg
244251 gtatcagccg aacccactgc cacagcaata actgaagttt aaacaaaatg
244301 aaaaaggatg ggcaggggt gggagacagg cccagaggtg tctgggatgc
244351 tgagctcccc tctgctgggg cctttctcat ggctctcttt tcctctcagt
244401 cttcactctt tctgagcaat ctcttacaca ccccggggtt tcaacaacta
244451 tctacatgat atgggaggat cagagtttgc tttgtgcttt aaaaataaat
244501 ctattgaagc ccctgactgg ctttacttgc agaaattccc tttgcagaaa
244551 agagaggctt ccagacactt tgcctaacta aataagaaaa tggacagttt
244601 atataataat tgaattacat taatgaggtc attctcagca ggtatgtatg
244651 acaaggctgg ggagcaaatg caaccttcta gaaaaaccac agtggtggtc
244701 attttaagtg aagaaacaca ttctttgttt tgttttgttt cgttttgag
244751 acaggggtgg gtctcactat gttgctcagg ctggtctcga gctcctgagc
244801 tcaagcgatc cgcccacctc agcctcccaa aattctggga ttacaggcgt
244851 gagctgccat gcctggccta agaaatacat ttttttttt ttttttttga
244901 gatggagtct cactctgtca cccaggctgg agtgcagtgg cgggacctcg
244951 gctcactgca actctcgggt taaagtgatt ctcctgcctc agccttctga
245001 gtagctggga ccacaggcgc ctgccagcac gcccggctaa ttttttgtat
245051 ttttagtaga gacggggttt caccatgtta gccaggatgg tctcaatctc
245101 ctgacctcat gatctgccag cctcggcctc ccaaagtgct gtgattacag
245151 gcgtgagcca ccgtgcccgg ccaagaaata cattctttac cacaaacatt
245201 tcaacaaatg caattttctc taacaaatat gcatagtttc aagattacaa
245251 gtcaactgtc cttggaagag aactattgaa attaaactct atgacaagaa
245301 ggctttttgc ccttctaagt accagaaacc caactacatg atgtccaact
245351 acagaaagag tacagactta acttaaatat tatggtaagc aatacataaa
245401 tattcgctaa ccttcccct tcatctccac gtgcacagtc atcgctttgg
245451 atcctcaaag cggttgtgtt ttggttttct ttttcactc agagtttctc
245501 gttaagtgtc actgaaactt gtggcataag atcgatcaac ggtattaacc
245551 cgaattgaat caaagcagat aaaacagctt gggcaacggc tgttttagcc
245601 ctttaaagat tccaaatctg gccttgttcc ccatcccaaa tggaagctgc
245651 tgacgctgga gactgtggag agaaagggt ggggcccagc acaggggccc
245701 aaggggttca acaagccaag gtgccaggtg gtggctcagg gactcacggg
245751 gcagacagtg tttgttattt atttaatta atggcctaca cttaaaagga
245801 gtttcataag taaacttctg gcttctctag aaaaaatgga tagctctttc
245851 tttcacccct ggaccggcaa tttcacatgc caatggcagc agccgggcag
245901 tggtggcccc ttagacctca tacacgctca ctctcttttt ggagaggaga
245951 gtcactgtca ctgtcttgtg gccatttcac ttattcatgc ctgggctggc
246001 tcctgcagac attggtggta aagagatcag agggtgtggc caaattccag
246051 agtggctcta agaacagatc aaaggacaca cacatacaca cacacacaca
246101 cacacacaca cacagcttg tgcatctaag ctccatccac agtgaagttc
246151 ccccagttcc tctcaccttg tctcctctca gcctttgctc aagctgtttt
246201 atctgccaga aacacgctcc tctactgtcc cctgcccacc tggtcacgtt
246251 ctattcaacc ttcatgatgt cacctctaca ggaagcctcc cggcccccca
246301 gtgaaggttc agatggatgt cagagagacc caaagtaaca gcaacttaaa
246351 aaaaaggcag accttttaatt cttttcaag ggagagtcct gcccagtgaa
```

FIG. 7 CONT'D

```
246401 ggccctccca gtgcctggac tcttctatgt gccgacctat ccgtgaggca
246451 cagcagacac agtgcctagg acccacgaaa atgttttaat ttcatttaga
246501 atcaggagga aaaaaagaat ataatgataa atccagcctg aattattttt
246551 gccgttttac taatacagta gtaaaatata atttaacaga agaaggggcc
246601 cacaaaggca aaggtgctta gggttcccaa aagtcataat gcaggccagg
246651 cacggtggct cacacctata atcccaacac tttgggaggc aatggtgggt
246701 ggatcacttt aggtcaggag ttccagacca gcctgggcaa cacggtgaga
246751 tcccgtctct aatacaatta caaaaattat ctgggtatgg tggcacgcgc
246801 ctataatccc agctgtttag gaggctaagg caggagtatc acttgaacct
246851 gggaggcaaa ggttgcagtg agctgagatc tcatcacagc actccagcct
246901 actgggcgac agagcaagac tccgtctcaa aagaaagtc atcatgcagc
246951 cctggtggt tactctcatc tatgtggtcc acgctggctc agcagtacaa
247001 tggagggaga gaacaaggaa ggagggata ggacatttct ctttaagggt
247051 ttaatttggg agttgcacat actattttc cactcaaccc attgtctgaa
247101 ccttaatctc atggccacac ccacctatag aggaggctga aaatgctgtc
247151 tttattttgg attgtcgtgt gcccaaataa aaagtgtatc gcaatgtgag
247201 aaggagaggg ccgctattgg gagaactagt tccctctgct aagtgacctt
247251 tctagttgct ttcatggctc caagagggag caggcagaag ctgcaatgtc
247301 cttgatgatc taacttcaga agccacatgc cattgtttcc acaatcctat
247351 tggtgacaca caggccaagc ccatcctgtg taggagggcc ccacgccagg
247401 catgaatata gggaggggag aatcactgaa ggccatctgg tgactttcta
247451 atgtctggga ggccctgtg aacttcctgt gtgggattca gtgagaccct
247501 ccttgctctt agaagagtgg ccccctctt ttttacttgt gtctattaag
247551 tgcatttcta tgtccttgga gcagacagac cctaagaaag cgatgaaggg
247601 agaaaaagac actattattg gtcccatcgc ctgttagcaa atacaggggt
247651 ctctgtggcc ttgtcttctt ggtagcctgg tgtttcttcc tggtatgtgg
247701 cattccaagc tggcccccac tcatctgcac aacaagagtg agcatcaggc
247751 ctcagggata tggccccaga cagaacaaag tccctgctcc ctggaacttt
247801 ccctcagtaa ggagagacag acaccaaaga aacacaggc gtaccagatg
247851 gtggtgttat aaacataatt aaagctgaat aagtatgtgt gtgctatttt
247901 acagaaggtg tgagggaagg cccctctgca gaggtgacat ttgcaccaag
247951 acctaaatga agagaggaag tgaaccataa gaatatggga ggagggccag
248001 gtgcagtggc tcacgcctgt aatcccagca ctttgggagg ccgaggcagg
248051 tggatcgcct gaggttggga gttcaaggcc agcttggcca acatagggtg
248101 accccatctc tactaaaaat acaaaaaatt cgccaggcat ggtggcatgt
248151 gtctgtagtc atatatat ttatacatgt agtcatatat atttccttcc
248201 atatggaagg aaaaaagtct gcaggaattt cacagtgaag aaatggacag
248251 gaggactgaa tgcaagatca ggagagagtc tttcaagaca ggactagaac
248301 aagatgggac tagaacgtgt ctatagccaa ggagcaactc gtgattcagg
248351 gaagcagaag agaggtgaaa tccagagacc aatgaaacga aatggcctct
248401 gactagagct gagccccatc tcccattgta ttaatagcag gagggggctg
248451 ggcacggtgg ctcacgcctg taatcctagc actttgggag gccaaggcag
248501 gtggattact tgaggtcagg agttcaagac caccccggcc aacatggtga
248551 aaccctgtct ctactaaaaa tacaaaaatt agccgggtgt gatggtgggc
248601 acccagctac tcaggggct gaggaaggag aattgcctga atcagggaga
248651 caaggttgca gtgagccgag attgtgccac tacactccag cctgggtgac
248701 agagtgagac tctgtctcaa aaaaaaaaa aagaaataaa taacaggagg
248751 gaaggcagga tgtggatgca gatggaagca ggttggagat gtggtgactg
248801 gaaggcgaag gggtttcgtg tgactgcttc tggtttctca atggagtgtg
248851 aggctcaggg tgatggccac aggggttcag aagatttgag ggggaaagaa
248901 aaagatgaga atgaatgact gtcctgatga tccaaaaaac aaaccactag
248951 ggcagtgctt ctaaacttta attgtggaaa tgaatcatct ggacgcctgg
249001 ggaccttgtt acaatgcaga ttcagattca gtaggtctgg gtgggcctg
249051 gcctcctgca tttgtaacaa actccccagt gatgcctgtg ctgttggtcc
249101 agcaccacgt tttggttagg aagggaagtg ctatggtttg aatgtgtctt
249151 ctccaaaatt catgttaaaa tttaatcccc agtgcaacag tattgaggtg
249201 aggcctacag gaggtggtta agtcatgggg gctcagccct catatggatg
249251 agattcatag cctataaaa gggctggagg gaactagctg ggtccttttg
```

FIG. 7 CONT'D

```
249301  cccttctgcc ttctccatgt gaggacacag cattcatccc ctctaaacga
249351  tgcagcaacg agggatggtg atgttggaag cagagacagc tgctttcacc
249401  agacactgaa cttgccgatg ccttgatctt ggacttcgca gccttcagaa
249451  ccgtgagata aattcctatg acttatcaat cacccagtct gtggtatttt
249501  tttatagcag cacaaacaga ctaacacaag aggtggatag gatttgcgag
249551  catggacctt ggaggtttgt ggcctcaatt taaagtgagt acattcaccc
249601  agctggtgtt tttctcttgc tgcttgggca cagagatgga gtaaatggt
249651  ctaatcaagg ataaagggag agccaaagag atagtaatat ttgaaaggaa
249701  gtgttttaa tgatgtgcca tgtaatctga gctgggtcag gaatgaagtg
249751  aaaaactaag agatgatgga tgatgatagg ggctgtgaaa ggaaaacaaa
249801  tcttggggcc cccaaatcac taagctaaag gagaaagtca agctgggaac
249851  tgtttagggc aatcctgcct cccattttat tcaaagtcac ccctctgctc
249901  actgagatga atgcatatct gatctaatca gaaactcaaa agaatgcaac
249951  catttgtctc ttatctacct atggcttgga agccctctcc ccactttgag
250001  ttgtgctgcc tttgcttcga gttgtcctgc ctttctgaac caaaccaatg
250051  ttcatcttat gtatgttgat cgatgtctca tgcctcccta aaatgtataa
250101  aaccagtttg tgctcagacc accttaagca catgtcatca ggacctcctg
250151  aggctgtgtc catgtgtgca tccttaactc tggcaaaatt aacttcctaa
250201  attgactgag acctgttcac aaggccaatg aatcatggtt cttcataaga
250251  ttaaataatt gctggtgtgg aagcattaga gccactaaac tggaaagaga
250301  ggacaaggtg gtcaggaagt gaggcgcttg aaagtgagaa taaggggcga
250351  cacggtcatt ggcgatgaca aggtcaagca agtgacctcc agagtaggag
250401  gctcaagatc atttgaggca caaaggtcaa ggaacggaga ggccaaggtg
250451  tcagacggat cactctccaa agagtgacac tagtagatgg tcaaaatgaa
250501  agcagtgagc ccaatgctca agtctgtaag ggacaaggag gaatgaccag
250551  ggtactggca ggtgacagta accaggaggg aggcaggatt ttagtctgat
250601  gacatgaatt tcaagagagc tttgtgcagc atctacaagg cactgggaca
250651  gaagacagac atagtctccc tcctaagtga agtgggttag gcaaggaagg
250701  gttctaggca aggaagttac atgatccagc tagattttga aaagatctct
250751  tggactactg tatagagaat ggattggagg gaggttcggt ggcattagga
250801  ggctattaca gttacttaga ctgaggttgt caaagggtgg accccagacc
250851  agcagcatca gcatcactga gaacttgcta gaaatgtaca ttttggggtc
250901  ccacctcaga tctactgagt cagaaactcg gggtggggggc cctgccattg
250951  gagttttaac aagctccccc agtgattctg atgcaagctg aagtcaaacg
251001  aaaatggtca cagaattatg gcagtcgaga gggagtggat gaagctacag
251051  cttgttaggg gaagaataag gacagggtag caaagtgtag cagggaagga
251101  gtgggaagca ccaggtttct gggaggagga agtggactgt tgggagtttc
251151  ctgtaccca aaggcacggg gaaggctgga ggaggagccg aggggcaggg
251201  caagatcaag agtttggttc tgtccgcagc atggggcaca tgtgttccag
251251  agaagctggc tggaaagtaa cgctgtgggc aagaactata ttccgccgta
251301  gttcccagga gaaatgcaag acatgctcct ggaggaaagc tgcgctgatg
251351  gctctgggac atgtcgtgac aatgacacac agtggctctc tgtggtccag
251401  ttaagcttgc caatattaca cacttgcaat tgagggcatg gtggaaagca
251451  cactgagctt ggaatccaga ggaatcagcc cctggggtta agtcttttcc
251501  caccagtcat ttcacctctg tgagcctgtt tctacatttc tttgttttta
251551  ttttatttta ttacttattt attttgtttc tgattttttt ttttttttt
251601  gagacagagt ctcactctgt tgcccaggct ggagtgcagt ggcatgatct
251651  ccgctcattg caacctctgc ctcctggctt caagcaattc tctgcctcag
251701  cctcctgtgt agctgggatt acaggcacct gcaccctgc ccggctaatt
251751  ttttcgtatt tttagtagag atggggtttc accatcttgg ccaggctgga
251801  cttaaactcc tgaccttgtg atacacccac ctctgcctcc caaagtgctg
251851  ggattacagg cgtgagccac cgcacccagc cgtttctgca tgtcttaaca
251901  gggattatga tatctgcctg aactacttac agggtacact gttagagcca
251951  aatgagccaa tgcaaatcca aatttattga taattctaaa attgtttcaa
252001  tgtaagtgca gcagtattcc aaataatcta ataattattc taatattcta
252051  ttatcaaaac tgctttttt gctggtagct gcccacctgc tatcatgtga
252101  tggcagtaga aagacgacca atctcttaa acacactttc cttcctggtt
252151  atggccttca attcactgta tgaggtcaat cctttgactg aaacttttgc
```

FIG. 7 CONT'D

```
252201 ctataaaatt gcagtacacc tggaatggta acactacaaa aaatacctac
252251 cttttattta ctgtgtacta cgtgctggtg tttcatatcc actatttcat
252301 atgccttgaa ggagtcttgt gcactagata ttgctatgct cactttatag
252351 atgaggacat tgggctcaga gaccagggga cttacccaaa ttcatagagc
252401 tcgtggaggg cagagccagc acctgactgt ttgtgcctgc ctgtgatgct
252451 gtagtctccc tgctcttgca agcagctttg gatgggcagg gttagggcac
252501 cggtcatcaa gcctgggaaa agggagctta gctggacaag ggaaggatgc
252551 caaaggctgg ggcttaagga tcagattcag ttgaccctac ccaaggcaca
252601 ggaattgttc tatggacttt ctgctctgct cttatgactt ttattcacaa
252651 gcagctttct aatgtctcaa ccttccatgg cacccaatac tatttgctta
252701 gatatttggt ggtgaaatct ttcaacagaa atgatggaag aactaagggc
252751 ccagggaggg ctccagagga aggtggactc cttgcgtcct ctaacctata
252801 gaacaaatgc acagaggggc tgggcgcagt ggctcacgcc tgtaatccca
252851 gcactttggg aggctgaggc aggcagatca cctgaggtca ggagttcaag
252901 accagcctgg ctaacatggt gaaaccctat gtctactgaa aatacaaaaa
252951 ttagccgggt gtggtggcag gcacctataa tcccagctac ttgggaggct
253001 gaggcaggag aattgcttga acctggaagg cagagcttgc agtgagccag
253051 gatcatgcca ctgtagtcca gcctgagtaa cagagtgaga ctcggtctca
253101 aaaaagcaaa acaaaacaaa agaacaaatg cacagagggg aggggaagga
253151 ggctgccaca gccctgggt ctcttttcca ggggtatttt ttttttttt
253201 ttttttggga gacgggtct cgctctgtct cccaggctgg agtgcagtgg
253251 cgcaatttcg gctcactgca cagccgcctc ctgggttcac gcgattctcc
253301 tgcctcagcc tcccgagtag ctgatactac aggcccggcc cccaccccg
253351 gctaattttg ttttgtatt tttagtagaa acgggtttcc ccgtgttagc
253401 caggacggtc tcgatcttct gatctcatga tccatccgcc tcagcctccc
253451 aaagtgctgg gattacaggc gtgagccacc gcgcccggcc caggggtctt
253501 aatacagttc atttgcaca cgaacagcat tatgccttgt gaactttggt
253551 gcaggcggga gagcgattag aggagtttca agactggtag tcgatgatac
253601 cagcatgtga catgagagat cggccgagcc aggaaggagc ccatgttcct
253651 tatctcatat acacagaaac caagggcctt gtccccaggc ccaggattgt
253701 ttagcacaac agaatcccag cctcccatg tgttactcaa tcgctttaat
253751 cctcttaaaa agaattgccg gccgggcgcg gtggctcacg cctgtaatcc
253801 cagcactttg ggaggccgag gcgggtggat cacgaggtga ggagatcgag
253851 agcatcctgg ctaatggtga aacccttct ctactaaaaa tacaaaaaat
253901 tagctgggtg tggtggcggg cgcctataga gcaagactct gtcgaaaaaa
253951 aaaaaaaaaa aaaaaaaaag ggttttctga tcgtgctctt ggtaccagtt
254001 ctcctgagag tgagcttcac tgtgctggat cacaaatgtc cggtggaaag
254051 acatctagct ggggccatct ctccacagcc acagcacaga gccttgcatg
254101 agagggaggg agggagggat ggatgggtga ttgccggaag aagatgcaga
254151 atatcccctg gactgcctcc aaatacaagt tcagtgatat agaacttcaa
254201 attggttagt ttttctggca tgaaaggcta tgtcttgggg gaacacctct
254251 cccactgccc cgcagtgtag ataccagcag ccgagtacat gtagttacca
254301 ctgtttttgt tttttttat gggtcctggc tccttcaatg gagaggcagt
254351 aagcaattaa aacccgcttc taaaccatcc taagtactcc tttggagtgg
254401 ctgcaaaaat cgatcatcct cacggataca aagggggaga aaagaaaaac
254451 aaaaggaatt actttaacat cttcatttc agactaggtt agggcagtaa
254501 aaaagatgac cagtggaggc aaacactggt ttagggctgt ggcagcggca
254551 gtggggttcc ggagagagaa gggagggtaa cagaggctct tctgatcctc
254601 cttgcttctg gggtctcttg ctgggcctct gagtaggtct gcaagtaggg
254651 ctgggcatcg gggctcattt tgaccacaag tgtttgctgg ttttggagtc
254701 aagcagacat gtgtcactgc ctggatttaa ttcccatagc tgtgtgaccc
254751 tcggccgttt gcttaatgtc tctgagcctt aatttactca cctgggagga
254801 acaataggac tgttcagagt aagtgaagta gcacactggg cgtcagggca
254851 cgttcggggc cgcgccggca cgcagagaac ctcgcccgct cggcattact
254901 gtctggaaac ggcttgcggg gacggtggag gataacaggg ggcgagcacc
254951 gcccgcagcc ggagtagccc tcgcgttttt tccttgacag cgcggccgag
255001 cgccgctgcg ggttgtggag actgtccgcc ctctagtggt cggcttcaaa
255051 agttgcttca aagacaaggc tgaatgaaaa gcgttggggc gccctaagcc
```

```
255101 gatgcactgc atggaaaggg ggctacctttcccttttccct ttactagagc
255151 ggacaaaggc tgttccatct tttttgggag ccatagaggg gatccggttg
255201 cactagcctg catcctcagg ctgctgaact gaccacggtg ggctaaactg
255251 gaaaagtttc tttgggcagg aaagactcag atttaacaaa catttactga
255301 gcacctacta cgttcctatc tctgtgcagg atgctttcac ttactttacc
255351 catttaaacc tctcagtaag accgggcacg gtggctcacg cctgtaatcc
255401 cagcactttg ggaggctgag gagggaggac cgcttgagtt caggagttca
255451 agaccaacta ggcaacagtg agacccctct ctacaaaaat taaaaagtta
255501 gctgggcatg gtggcacacg cctgtggccc catgtggccc cagctactag
255551 ggatgctgaa gtgggaggat tgcttgagcc caggagattt gaggctgcag
255601 tgagccacga ttgtgccatt gcactccaac ctgggcaaca gagcgagact
255651 gtttcaaaaa aacaaaaaca aaaacaaaaa acctctcggt aacctgtgag
255701 tgagagttta atatattgttt ttctgataag atggtgaagc actctcagga
255751 aagttattgc acacagtgga atcatggcta cgtggctacc tcaggatttg
255801 tattagtaca cttagggctg ctgtaatgac ctaaacatgg gtggcttatg
255851 gcccatccta ataacctcac tttaattgga ttacctctgt aaagattctg
255901 ctctaaataa ggtcacattc tgaggtgtag gggttagaac ctctacatat
255951 aaaatttcag gaaagtaatt caactcataa caggattttt ttaatttct
256001 ttttttaga gatgaggtct cgctatgttg cccaggctga tcttgaactc
256051 ctgagctcaa gtgatcctcc cacctcggcc ctcaaacatg ctaggattac
256101 aggcattagc cactgcacct ggccctataa caggatttaa cccataactc
256151 ctgatcccaa gcctgatggt tacctgtata ttcaagcagt gcttcttaaa
256201 cgtggatgta tattggattt cctggagaat tttaaaaaat atattgatgg
256251 gccaggcgtg gtggctcatg cctgtaatcc cagcactttg ggaggccgag
256301 gcgggtggat cacctgaggt taggagttcg agaccagcct ggccaacata
256351 gtgaaacccc ttctctacta aaaatacaaa aattagccag gtgtggtgcc
256401 acacgcctgt aatcccacct actcaggagg ctgaggcatg agaattgctt
256451 gagctcagga ggtggaggtt gcaatgatct gagatggtgc cactgaactg
256501 cagcctgggc gatacagtga gactccgtct caaaaaaaaa aaaaaaagtg
256551 tgtatgtata tatggttttg agttcacctc aagagattac gatttaattg
256601 gcacatagtt gacatagttg tgccaattaa atgtgtatag acactggatt
256651 aaaaaaaaaa aactcctcag gtggttctaa ggagaggtca agattagaac
256701 cattgactta gagcaccttc ccatcaccat ttgataggct ccacctcaga
256751 ggaaggataa gccctctcct tgcttcgctg ccagggaaag gaggcccaat
256801 ttgtctttag ttctgcaatc ttggctccat ttcggttttct attttctta
256851 ttcttttttt tttttttttg agatggagtc tcgctctttt gcccaggccg
256901 gagtgcagtg gcatgatctt ggctcactgc aacctctgcc tcctgggtta
256951 aagtgagtct tctgcctcag cctcctgagc agctgggatt acaggcgcct
257001 gccaccacac ctggctaatt tttgtatttt tagtagacat gggtttcact
257051 atattgacca ggctggtctc aaactcctga cctcgtgatc cgcctgcctc
257101 agccccacaa agtgctggga ttacaggcgt gagccaccac aacaggccta
257151 tttttcttat tcttcaagca catctgctct tcacacatgt cagactcaca
257201 gcctagtaca tgacacacat taggcccctta acaaatatct gaagaagaaa
257251 aggagggaga agaatcacaa gggaagaagt gcaaagggat gggattggaa
257301 taggggaact cttgaaaaag tgatgtttct ggaaaaggag gatttcatgg
257351 tacccactgg gggagaatat tagtgcaaat agtgcccaat gatggataat
257401 catccaggga tttgccttcc agtgatacca cataagggca tcaaatcaca
257451 ttcacaacct taaatttaat agttgtgcat gaggtgagga cgaattacct
257501 tggggtatca gttccccttc ccaccaaacc cccagagctg gcacatgaca
257551 gtccaacaag gtctcctccg aatgctgagt gccctggaag gcagagtgaa
257601 gctctgaccc cattgtgttg tgaggtggag agtaaatgac agtggtttcc
257651 ttgtgccctg gcttgtttct ccccttggg cttcatccat tctcaccctc
257701 agagctaact ggggctgact gggaatgagc taattaggac tggcctttcc
257751 ctatatgtgt tccccagaaa aggagcatat accttcagga aacatgaat
257801 tcacaggtca aagtagcaga tttcagaatc acaactatgt gaaatgaaac
257851 atagcatttt agattacaga atccaactat atatataaaa acagttgcat
257901 agataatgtg atattggcct aataaatata caaaaagaga taaagaaga
257951 taatgacaat gtagataaga acaagaaaac ataaaaaagc aatattagat
```

```
258001 aagtaaaata tcatagttga agtgaacaca tcacatggat aaacaacaaa
258051 atggatagag ctgcaaaact aattgtcaac ttggaagacc aggcggagga
258101 aatctttcag aagagataag aaaataacaa agacgtataa aatataaaga
258151 aaaaactagg ttatgtggaa gacagaagta ctaacatcta ggtaataaga
258201 attctagaaa gaagaaaaat gaacagaaag aaatgtttga agaaaaatga
258251 gataatcttc cataactgta aaaagatgaa agaaagataa aaaaggttat
258301 agaaaaaaga taagaaaaaa tccacaccag aacattttat agtaaaatta
258351 agaatttcaa ggctggacat ggtggctcac acctttaatc ccagcacttt
258401 gggaggctga ggcaggagga tcacttgagc ccaggagttc aagaccagca
258451 taggcaacaa agtgagatcc catctctaca aaaagtttta aaaattaggc
258501 atggtgatgc atgcctgtag tctcagctac tcaaaaggct gaggtgggag
258551 gatcatttga gcccaggagg gtggggctgc agtaaactgt gatttcacca
258601 ctgcattcca gcctgggtga cagaacaaga catcatctca aacaaacaaa
258651 caaaaaaacc caacaacaac aaaaaaaaga attcaaggaa aattctaaaa
258701 gattataaag agaaagagaa catcacaaaa agaggactga agtcagattg
258751 acatcagatt ttttttttt tttgagacag agtctcactc tgtcacccag
258801 gctggagttc agtggcacaa tctctgctca ctgcaacctc cacttgccag
258851 gttcaagcaa ttctcctgtc tcagcctcct gagcagctgg gactacaggc
258901 acctgccacc atgcctggct aattttttt tgtattttta gttttacag
258951 ggtttcacca tattggtcag ggtggtcttg aactgctggc ctcaggtgat
259001 ctgcccacct tggcctccca aagtgctggg attacaggcg tgagccacca
259051 ggcccggcct gacatcagat tttttaacag caacaactga tgtaagaaaa
259101 cagtggaatg agctgggcat agtggctcac acctgtaatc ccagctactc
259151 cagagggtga gatgggaaga ttgcttgaga ctaggagttt gagaccagcc
259201 tgagcaacat agtgagaccc catctctaaa aaaatatttt aaattagccg
259251 ggcacaatag tgcactccta taggcctagc ttactcagga tgctcaggtg
259301 ggaggatctc ttgagcccag gagtttgcgg ctgtagagag ctatgattat
259351 agtattgcat tccagcctgg gcaatagcat gagactccat ttctaaaaaa
259401 aaaaaataag agaaagaaaa agggaaaaaa aaaaagaaaa aagaaaagaa
259451 aaaaatggtg gaggaatggt atggtattct caaaataata aaggcaaaga
259501 aaccatcctc aatttattt atttatttat ttatttattt atttatttat
259551 ttatttattt tgagacagt gtctcgctct gttgccaggc tggagtgcag
259601 cggcacgatc ttggctcact gcaacctctg cctcttgggt ttaagcaatt
259651 ctgctgcctc agcctcctga gtagctgaga ctacaggtgt gcaccaccac
259701 gaccagctga ttttgtatt tttagtagag acagggtttc actatattga
259751 ctagaatggt cttgatctct tgacttcgtg atcctcccac ctcggcctcc
259801 caaagtgctg ggattacagg tgtgagccac tgcgcctggc ctatttattt
259851 ttttgagata agagtctcgc tctgttgccc aggctggagc ctggtggtgc
259901 aatctccact cactgcaacc tccacctcct gagttcaagc aattctcctg
259951 gattagcctc ccaagtaaat gggaccacag gtgtgtgcca ccaggcccga
260001 ctaattttg taattttagt agagatgggg tttcaccatg ttggccaggc
260051 tggtctcgaa ctcctgacct caggtgatcc acctgccttg gcctcccaaa
260101 atgctgggat tacaggcgtg agccaccatg ccctgcccat cctctatttt
260151 tatatccagt tggccattca aagataaggg catgataaaa aaaaatatta
260201 tcaggcacag aagttctcag aagatttacc acacaaaggc tatgctgaaa
260251 actattttag atgaaaggct taaataaagg gagagtaaat ctagtagata
260301 ctgccagaga tatgtaaagt aaagatgacc aagtacaccg gtaaaatttc
260351 tttgacttaa aagaatagcc aagactaaag aaaaagagaa ctcatagaca
260401 caataatctg gcatcaaagt gtagataata acatgatgtg gattggggc
260451 acagagatga agagatgagt gtataaagtt ttgttcttat gggggaagag
260501 atagttacca atttaaagaa atggttaata atatatatag aaaaagtgag
260551 tcagactgaa aaaaaataaa gtggtagaaa caggtccgaa taaataatta
260601 caataaatat aaatgaacta aactcatcag ttaaagacaa agatggaaaa
260651 atgtgatata acaaaaattc aggtatgtgc tattaacaag agataaaact
260701 aaagcataag gaattgcaaa gactctaagt aaatgaataa aaaagatatc
260751 agtaaaatac taatcaaaat aaagctggtt tatctacagc aatattagat
260801 aaaatggact taaaggcaaa aagatacata gcatgtatgc atttaataaa
260851 gcaaaaggtg gcccagggtg atggctcacc cctgtcatcc cagcactctg
```

```
260901 ggaggttgag gcaggtagat cacttgagtt caggagtttg agaccagcct
260951 gggcaacatg gcgagaaccc catctctgaa aaaaaaaaaa aatgcaaaac
261001 ttagccaggt gtagtggtgc atgcctgtag tcccagctac ttggaaggct
261051 aacatgagag gatcatctga gcctggggaa gttgcagtga gccatgatca
261101 tgccactgca ctccagttgg tgataaaaga aaaagattga taaatgttgc
261151 tttgttagag aaagtaaaaa gttatatata gaagatattc aaaacacata
261201 aaactggcaa aggactggta tcataaagaa cttctgcaaa tcagtaaaag
261251 aaaaaacaca taagcagccc aataggaaaa tgggccaaaa aaagaactgt
261301 tttcacagaa gagaaaacac atgatcaata aacatatgaa gagatgttta
261351 acataattag taattgggaa gtataaattg agactacagt ccgggtgtgg
261401 tggctcacac ctataatccc agcactttgg gaggcctagg tgggcggatc
261451 acgaggtcag gagattgaga ccatcctggc taacatggtg aaaccccgat
261501 tctactaaaa atacaaaaaa attagctggg tgtggtggca cgcacctgta
261551 gtcccagcta ctcaggaggc tgaggcagga gaatggtgtg aacccgggag
261601 gcggagcttg cagtgagctg aggtggcgcc actgcactcc agcctgggca
261651 acagagcgag attccgtctc aaaaaaaaaa aaaaaaaaaa ttgaggctac
261701 aatggcacac aattttatac tcattcatct ggtaaaaatt tgaatggtct
261751 gataacacca aatcttatca atgctggtga gaatgtaaaa ttgtataact
261801 actttggaaa agtttgacat tttctcctaa atttgggcat tcatatacta
261851 ttatgggttg aattttgtcc cctagaataa aatgttaaaa ttctaactcc
261901 tggaaccttc aatgtgatct tatttgaact ttgcagatgt gagtagctag
261951 gttataatga tgtcatactg ggccctaaat tcaataggac tggcatcctt
262001 ataagaaaag aagaggccag gcacgggtct catgcctgta atcttagcac
262051 ttcgggaggc tgaggtgggt ggatcacctg aggttaggag ttcaagacca
262101 gcctggccaa catggtgaaa ccccatctct actaaaaata caaaaatttg
262151 ccaggtgtgg tggcggacgc ctgtaatccc agctacttgg gaggctgagg
262201 caggagaatt gcttgaaact gggaggcgga ggttgcagtg agctgagatt
262251 gcaccattgc actccagcct gggggacaag agtgagactt catctcaaaa
262301 aaaaaaaaaa gaagaagagg agagacagag acagaaacac acagaggaga
262351 agaccatgta aagacagaga tagaaattgg agtgatgcat ctacaagcca
262401 cggggtgtcc agggatgctg gcaaccatca gaagccgaga gagacatggg
262451 acagattttc cctcagaggc tcccataggg aaccagccct gaggacactt
262501 actgtgagat aacacatttc tgttttttg aggcacccag tttatggtaa
262551 tttgttagag cagctctatg aaactaatac acatactcaa tgacccaaca
262601 attctactcc taggtataga cccaacataa accatttcat gtgtacaagt
262651 gactgcataa ggaagttcac aggatttcag ttcacaacag caaaaacctg
262701 caaagaacct aaaagcctaa ctataaaaga cagaataaat aaattgtagt
262751 aaatccacgc aatggaatgt tattcagcag tcaacatgaa tgaactatag
262801 caatgagggg gtctatctgc agaccctgac ccaaacgatg gatgaatgaa
262851 gtacactgac acacagatat tctgctatgc cagtccagct gagtgtctgg
262901 gccacttaca gactccaagc agagtgctgt aaacagtcac gaccatggcc
262951 ctgaccaact agtgagactc gcatttattt agtaaagatg aattgacaaa
263001 ggcttgagtc aacaccacca gagggtaatt gacattgtgg acttcctgta
263051 gaaagtaatt aagcaccggt ggtagatcaa aggttagtct taaacaacct
263101 agctagatac actactctgc cttcttcctt acccacttga agcttttac
263151 tcaaggtaag gattaggttg ccttcagcca ttgtcttatc ctgagacttc
263201 tgtaaaaacc ttcaggcctt ccaagaaagt ttgtgtttat ttttataact
263251 atctttaata ttttccccac cagcctgatt gaactcccac ataacaacac
263301 acaaaaatat gaggaatctt aacaatataa taataataaa tgaatctaaa
263351 gagtttacat attctgcaat gcatttttaa taaaatttat gaccaagata
263401 atagttcctt tttatgaatg caaatacgtg caattcaact atatgaaatg
263451 gaaggcaagg aaattgtttt tttatttttt tgcaaacact atggtgactt
263501 aaaggcaagg aaattgttaa catggaattc agcaatatgg ctaccttgag
263551 tagacaaagg cagagggaca cgatgggaaa agcaaccata tggttagatg
263601 taggttgttg tcaaggtctt agtttttgct tgagatggtg ggttcatgag
263651 tatttatcta tgtctacagc tatgtttata tgtatattaa cataacaata
263701 tttaatggag gaggccactt aaggaccaca gaggaaagta tgccataaat
263751 aggattagaa ctaattcttt ttttttttg tcttgagaca gagtttcact
```

FIG. 7 CONT'D

```
263801 cttgttgccc aggctggagt gcaatgccgc gatcttggct cactgtaacc
263851 tccgcctcct gggttcaagt gattctcctg cctcagcctc ccaagtagct
263901 atgattactg gtgcctgcca ccacacccag ctaattttg  tatttttagt
263951 agagatgggg tttcactatg ttggccaggc tggtcttgaa ctcctgacct
264001 caggtgatcc acccgccttg gcctctcaaa gtgctgggat tacaggtgtg
264051 tgccaacgca tctggtagat tagaactaat tctaatccaa tcctgtgcat
264101 ctggggctaa acatccccca aattgttggg ctttcccaga tttgtccatg
264151 attctacaaa ctggtgcttc tggctaattc tgattttcac aagggtctgg
264201 aaattggaat attttttcca cgctaactct atgacctgca gtgtggctaa
264251 ccaatctaga ccaaacatgc agctctggat tgttcaggat ttagtgtgcc
264301 aatttagata gaaagctcaa ttaattaaaa taaagaagca cagagaccaa
264351 aagttcattg agttcaagta gaatcagctc aatgggtggg aaaaagaaaa
264401 aagaatcagt tcctataaaa aaggacagca tagttgctag aaccctctag
264451 agatgtacag atattagata gttttggcag gaagtggtgg ccaaaataca
264501 tgaaacaaca acctgaaaaa ataagagtta atcagggatt acagcaggga
264551 tgaaaacaaa caagccaaaa agccacagca acaacaaaaa caggtggaag
264601 ataacaggaa aatctaatct tcactgccca tgggctggaa tgtaatgttt
264651 tggctatgtt tttcttcttc tttttttttt tttttttttt gagacggagt
264701 ttcgctctgt cacccaggct ggagtgcagt ggcgcgatct tggctcactg
264751 caagctccgc ctcctgggtt cacgccattc tcctgcctca gcctcccgag
264801 tagctgggac tacaggcgtc cgccaacacg cccggctagt ttttgtatt
264851 tttagtagaa atgggatttc accgtgttat ccaggatggt ctcgatctcc
264901 tgacctcgtg atctgcccac ctcggccccc caaagtgctg ggattacagg
264951 cgtgagccac cgcgcccggc cttggctatg tttttcttgg taaacatctc
265001 tactatctgc ttttgaaatg atggagctac ctttcagttt taaaaacaat
265051 atatttcagg catctcaagt aatccacaat ctggaggcaa aagtcaagac
265101 tgagttgaca gagcacaaat ctgtttcatt tgactacatt aaagaggttt
265151 gcattctttc aagggcttac tagcgagttg ttcagaagca gtactgacac
265201 gggggcctgg gattgttgag ggatgcttat gcacagagag gaaggtttgc
265251 taatccagga gcactgaatc atcatgatgt aaacttgcag gacttcatgg
265301 cttcagtgat acatcattga tctttaattc cagtccacag aactttttt
265351 tatggtaagg aaaaggatat gggaagaaaa aagtattata agcatgtttc
265401 tcatatttct tccctctttt acctataaa  taaaagagca aaggtattac
265451 tgagcaaatg ttctcttgaa aaacttgatt tcttcttatg cttggaaatt
265501 ttgctataga gatagtcatt gctactgttt acagtagaca ttccaaccct
265551 gaaaactaaa ctctgaagta tttactatgc ttagataaat cacatatttg
265601 tcctcatgag tacagcctgt tcaggtttgt acataccatt gcgtaattcc
265651 ctaagaactc tttccaattt aaaaggatga ctttggacac ctttgtggaa
265701 gttgatagga aagatttttg ctctttaaaa tacttgttaa ataggccagt
265751 taaagtatg  ctttgtactg aattttgcct ttatcagtaa aggctccaag
265801 aatgttgata aaataagaga aaaagaaatt gggcttttct cctgccagaa
265851 ttggaaggga gagacccaaa actaagaacg gaaaatctgt cataataatg
265901 gcagaatcct caaaagaaga tacacaaata aatgcagctg aggaacctgg
265951 agacttccct ggtttctgtc ccttgtgaga cttcaaatca taaaataccc
266001 taatatcttt ctgtaatctt ctgtcatgtt ctaaaatgtc taaaatattg
266051 aaacagtcct tattatcaga aaaaagtaat catgaacaga gcccagaata
266101 tggtataaaa cattacctta ctgttctcat catgtcattg ttcagtccta
266151 cctccaaaca atgtcccatg agaaaaccca gaagacatct ccctcactaa
266201 agcattgaga aatgcattaa taatggagc  acctgcaacc tctttcaaag
266251 gagagctctg tggttgctct cttctatagg gtaggtggaa aatatgccat
266301 tgacatggtc tccccaattt caatgatggg atgatgggat ctcagagtgg
266351 cataggtagg ggtggcactg aatctccaag gacaaagtaa atgcatccac
266401 tgtaaagggc aatcagaatg ctttggcctg cagacatatt tgatggtggt
266451 taagttatgg tgttcttagg aatgaaatag atgggcaatc taccattgta
266501 ttgcttgatc tgtaacagag ggaaaaattc taggtctggt agctaaaaac
266551 ctgatgagtc actgcagtgg acagtcatgg cctcttgtgt tgagatctaa
266601 gtcaattcac agagccaaag ctccttgatt aaagaggagg ctgggagcca
266651 ggcacagtgg cccatgccat cccagtgagt caggaggctg aagcaagagg
```

```
266701 attgattgct tgaagccagg agtttgacct cagaccctac gaaaaaatta
266751 atctaaaatg tcggggcgcg gtggcccatg cctctaatcc gagcactttg
266801 ggaggcacag gtgggcagat cacaaggtca ggagtttaag accagcctgg
266851 ccaacatggt gaaaccctgt ctctctaaaa atacaaaaat tagctgggga
266901 tggtggcatg tgcatgtaat cccagccact tgggaggctg aggcaggata
266951 attgcttgaa ctgggacccg ggaggcggag gttgcagtga gccaagattg
267001 caccactgca ctccagcctg ggctacagag ggagacacca tctcaaaaaa
267051 aaaaaaaaaa aaaaaaaatc taaaatggat catagatcta aatgtaaacc
267101 tagaattata aatctactag aaaaaatata ggacaaaatc tgtgggaccc
267151 tggcataagc aaagttttct taagtagaac acaaaagaag atataaaaga
267201 aatagatggg gcttggcatg gtggctaaca tgtgtaatcc cagcactttg
267251 ggaggccaag gtgggctgac cacctgaggt caggaattcg agaccagcct
267301 ggccaacatg gtgaaacccc atctctacta aaaaaaatt agccgggcat
267351 ggtggcacat gcctgtaatt ccagctactc aggaggctga ggcaggagaa
267401 ttgcctgaag ctgggaggtg gaggttgcag tgagccgaga tcacaccact
267451 gaactccagc ctgggccaca gaagaaaatt ccatctaaaa aaaaaaaaaa
267501 gaaaaaaaag aaaaagaaat aggtaatcag ttgggcttca tcaacattta
267551 aaacatttct ctttgaaagt cagttaagaa aatgaaagtc agctaggtgt
267601 ggtggcttac gcctataatc ccagcacttt ggaaggccaa ggcaggagga
267651 tcacttgagc tcaggatttc gagaccatcc tacgcaacag agcaagaccc
267701 cacctctaga aaaaatttta aaaattagcc aggcagggtt gtgcgtgcct
267751 atagtcgtag ctatttggaa ggctgaggtg ggaggatcac ttgagcaaaa
267801 tcaaaactga ttttcattaa atctcaaagt aatctgttga ctgaaagaaa
267851 ccaaacaaag atatatattg tattatttca cttatatgaa attcttgaaa
267901 ataaaaacta acttatgtag ctagactgca gatcagtggt tgcctgggga
267951 caggttaaaa agtgcaatga actgcagaca ggtatgagaa aaccttcaat
268001 ggcaatggaa atgttcagca tcttgtttgt ggagatggtt tcatagttac
268051 atatgtttac caaaacttat caaatagtga acttcaaata tatgcagttt
268101 attattcaaa attatacttc aataaagttg tgaaaatggg agcggggaag
268151 caacaaatac tggtgtgagt caacagcatg aaccatatca ccttttctca
268201 ttttccagaa gtatgctgag ttccttggtc agccaaaata accaccctct
268251 cgcccatatg agaggatctt ccttgtccat tttcccccat agtacctgtc
268301 attttttttt tttctgctgc tataacaaag gaccacagat tgggtcactc
268351 ataaagaaaa gaagtttagg ccaggcacag tggctcacac ctgtaatccc
268401 agcactctgg gaggccgagg aaggattgct tgagcccaga gttcaagac
268451 cagcctgggc aacatgatga gaccctgtct ctacaaaaaa tacaaaaatt
268501 agctgggcat ggtggtgtgt gcccatagtc tcagctactt gggaggctga
268551 ggagggagga ttgcttgagc cagggaggtt gaggctgcag tgagctgtga
268601 ttgtgccact gtaccccaac ctgggcaaca agcaagacc ccatctgaaa
268651 gagaaagaga gagagagggg ataaaaaaga gaaagaaaga aagaaaaga
268701 aaagaaaaga aaagcttact tggtgttgcg ggaagtcagg gaccctgaat
268751 ggagagactg actggagcta cggcagagga acataaattg tggagatttc
268801 ttcttaatat ggacatttat cagttcccaa ataatactat tataatttct
268851 tatgtctgtc tttaatctct ttaaacttta atctcttaat cctgttatct
268901 tgctcactgc aagctctgcc tcctgggttc acgccattct cctgcctcag
268951 cctcccgagt agctgggact acaggtgctt gccaccatgc ccagctaatt
269001 tttttctttt tgtatttta gtagagacgg ggtttcactg tgttagccag
269051 gatggtcttg atctcccggc ctcatgatcc acctgcctcg gccttctgaa
269101 gtgctgggat tataggcatg agccacagcg cccggcctga tcagaacatt
269151 ttttaatgaa aggatctaga aagcaacttg gaagtgtaaa tagtcacctt
269201 cattttctct aacttgatca agactagtgg gtccatggcc ctgtgttagt
269251 tcatgcattc atctcagacc caaatgaaag tttcaactcc caaaatgcag
269301 ttccttagat gctcgtctgg acgtgatgac gtgcccgcca tataagaagg
269351 tgcaatcata ggtatcacag gtagccagat agaagacatt tttttctccc
269401 aaaattattc cttggagtgg ggagtgatat gggggaagag ctcccatctt
269451 aagggcaca cactgagttg cttatgctac ttccttgttc aaaatgaagt
269501 aactgcctta atctaaaaaa agaaaagaat atttacaaca ctgaaaatga
269551 atgaactacg atttatgtat agcatggatg aatttcataa acattggaca
```

FIG. 7 CONT'D

```
269601 aaagaatcca gacacaaaat agtggttgcc tttgggcaat atagaagggt
269651 gcaagtggaa gtagcctcaa gaagtttct ggggtgctgg taaggttcta
269701 ttttctaaac tatgtggtga ttaaatatgt gtattcactg tgtggtaatt
269751 aatcaaactg tttactttt ttttttttga gactgagtct cgctctatcg
269801 ccaggctgga gtgcagtggc ttgatgtggg ctcactgcaa cctctgcctc
269851 ctgggttcaa gtgattctcc tgcctcagcc tcctgagtag ctgggattac
269901 aggcgtacgc caccacccc agctaatttt tttgtatttt tagtagagac
269951 ggggtttcac catgttggcc aggatggtat caatctcttg accctgtgat
270001 ccaccagcct cgggctctca aaatgctggg attacaggcg tgagccactg
270051 cgcccggcca acttttaaaa aaaatttag gtaaaaccca cataacatgt
270101 aattgactat cagccatttt aaagtggaca attcagtggg atttagtgta
270151 ttcacaacgt tgtgcaacca ccacctctgt ctagtcccaa gatatttcc
270201 tcaccccaaa agggaacccc acccatacc atcaagcaat tgctcctcat
270251 tcttctgagc tgttactttt ctacactttt ctacaagcat gttttacttc
270301 aatttaaact ttagcccatg aaatctaggc aagacgagga ggagaatgaa
270351 gtcatatagg agctgatgaa tgtcaagcca tggtggggtg ggccactggg
270401 ttgaagattt tgaaaaggtt gaagaagtat ggtagtggac gcacttgagt
270451 aagtgaattg aaaggaaaga ggtagtggtc agagggtagg atgcttaaat
270501 aaagatttca caaatgcgtt catttctgtt gatcccaagg aagtgaccgt
270551 gtgagtgtgt agctgaggtg gaatggtgaa aaagatcatt gaggacacat
270601 ctgttaaaga cctaagaagc cagagcattg aatggttcaa ctacatggcg
270651 ttaggtggtt ccaaccaatc aatgctgagg tcacaaaaat gggtaaaaat
270701 gacatggcag gagttgggga ggaggggaaa agcaggaagc taagtgcaag
270751 tctctcctgc atggaggggc atcgccaaga agtagctcac agcttcaagg
270801 aggaggtcaa gggagttaga tgacctgacc ttcagaagag ctgaggattt
270851 tggaggaggg aataggaatt ggaaactgca actgcaggcc atgaggacac
270901 tgcctaataa tgccacagtg gccttgggga cagccatgtt tcaggtaggg
270951 caggagaaga gatggaggat gtgggagagt taagatcac agagaggagc
271001 ttctgagaac acagcgaggt gtgggagagg cagtgcttgc atcatattgg
271051 aggacagaca tggcaacaca aagacaggta ggttgggggt gactggaaaa
271101 caggatggag gctggactgg attcagcctg aagatacact cagggtgagg
271151 gtggcaacca gacccgacga cgtgtgtcct ggcaatttct ctccaagaaa
271201 ccactagtga tgaagcagtg ctttaggtgc ttgggggttg agcaccttcc
271251 tgatatgtag tgttaacagc ttataaatgg ctatgtgtga cttttttttc
271301 ttctgatcaa cgctggtcct taatcaccat gttggattac ctcctgctat
271351 ggtttgagtg ctagtcccct gcaaaactca tgttaaaatt tatttgccat
271401 tataacagta tcaagaggta gaacttttaa gaagtgataa gactatgaag
271451 gctccatctt catgagtgga ttgatgttgt tataaaaggg agagtttgac
271501 cctcttttgt cctctcttgc ccttctgcct tttgtcatgt gatgatgcaa
271551 caagaaggcc ctcaccagat gccagcactt tgacactgga cttctcagcc
271601 tccagaactg tgagctaata agttcctgtt tattgtaaat gacccagtct
271651 cacatgttgt tatagcagca caaaaatgga ctgagacacc ttaagaggga
271701 gatacatgct gctgtggtgg atatattaga gattaattta gaaagattat
271751 taaatcactg aagaccttt aaaaattgat tttctttggc caggagcggt
271801 ggctcacacc tataatccca gcactttggg aggccaaggt gggtggatca
271851 cgaggtcagg agatcgagag catcctggct aacacagtga acccctgtct
271901 ctactaaaaa tacaaaaaat tagctgggtg tggtggtgag tgcctgtagt
271951 cccagctact tgggaggctg aggcaggaga atggcgtgag cctaggaggc
272001 ggagcttgca gtgagctgag gtagcaccac tgcactccag cctgggtgac
272051 agagcgagac tctgtatcaa aaataaaata aataaaata aatttctca
272101 actacaaaga tagtgagatc acaattatta tcatggtcct taagatttt
272151 ttgacattga aaagtacttt gtaagcata tatgtgataa aacacttgaa
272201 ttcagactac ataaagaaca ctcaaaactc aacagtaaga gaacaacaac
272251 ctaataatgg ggaaaaaatt tgaacaaaca ctccaccaaa gaagatacac
272301 aaatggcaaa caagtacatg aaaaaatctc aacgtcatca gtcattggga
272351 aaatgcaaac tgaaaccaca cacagaaact gtgaaaatta aaaagactga
272401 ccatgattag ctatggcagg gacatggaag aactgggact ctcatacact
272451 tctggtgtaa atattaaatg gttaaatgtt ggaaaacagt ttggcagttt
```

FIG. 7 CONT'D

```
272501 ggtaagagct aaatgtacac ctactgcatg atccagccct tccactccta
272551 gtatttatcc tgagaaatga aaacatacgt ccacacaaag acttgtgtgc
272601 caatgttcat agcagcttta tttgtaacat aactaaactg ggaatagccc
272651 aaatatccat taacaggtga ataaacaaat tgcgatacat ccatgcaatg
272701 aaatactact cagcagtgaa aaggaatgaa tggttgatac ataccacaac
272751 atgggtgaat ctcaaaatag ttatgtagag tgaaaacagc cagatcccct
272801 ccattaaaaa gaagtatata cagtatgatt ttatttatat aaaattctag
272851 aagattagat ttaatctgta gtgacgaaga gacaaaggag gtgggataga
272901 aagaggcaga gacgggggtt accaaggggc aggaggaaag ttttggggt
272951 gagatgggta tgttttgtct tgagtgtggt gatggtttca tgatttatac
273001 atatgtcaga acttatcaaa ggtccggcat ggtgactcaa gcctgtaaac
273051 ctggggcttt gggaggcaga agcagcagga ttacttgagg ccaggagttt
273101 aaggctgcca tgggctatga ctgtgccact tcactccagc ctggataaca
273151 gagtgagact ctgtctctaa aattattttg ccaggcatgg tggctcatac
273201 ctgtgatccc aacacttggg gggctgaggc agaaggattg cttgaggcta
273251 ggagttcaag accagcctag gtatcaaagc aagaccccat ctcaacaaaa
273301 agtttaaaaa attagccagg tgtggtggca cacatttata gtcccagcta
273351 ctctggaggt gggaggattg cttgagccca gaagttcaat gctgcagtga
273401 gctgtaatag ggccgctgca cttcggccca ggtgacagat tgagaccctc
273451 tctctctctc tctctctctc tctctctctc acacacacac acacacctcc
273501 acacatacac acaattggga tgatagtagt aactacgtca gaggcttgtg
273551 gtgagaacag aaagcattca gaatagtctc tggcacgtat agacagtcaa
273601 taaatgttag ctaattttag aaaaatattt ctggcaaaat atacataaca
273651 taaaacttac cattttatat gtggtaaaat atcatttcaa ccatttttaag
273701 tgtataatgc agtggcatta atacattcac gatgttgtcc aatcatcaca
273751 actacctatt tccagaactg tttcatcttc ccaaactgaa acttcaaagc
273801 cattagacac taacttccca ttgtccctcc tcccagcccc tgcaaccctc
273851 tattctactt ttgtctttat gaatttcact accctaggca cctcatataa
273901 atggaatcat acaatatgtt ttcttttgag tctggtttat ttcacttagc
273951 gtatgtcttc aaggttcatc caggttgttg tgtgaattag agtttccttc
274001 cttttcagg ctgaataaaa ttccttgtat gtagacacca cactttgttt
274051 attcattcat cagttgatgg acattaaggt tgcttccacc ttttgagtat
274101 tgtgaataat gctactatga acatgggtgt acaaatatcc ctttaagccc
274151 ctgctttcaa ttctttgggg gtatatactt agtgaaattg ctgggttata
274201 tagtaattct atttatttt ttgagatgga gttttgctct gttgctcaag
274251 ctggagtgca gtggcatgat cttggctcac tgcaacctct gcctcccagg
274301 ttcacacaat tctcctacct cagccttcca agtagctggg atttcaggag
274351 tgcaccacca cgcccagcca ctttttgtat ttttagtaga cgggggttt
274401 ctccatgttg gccaggctgg tctcgaactc caacctcag atgatctgcc
274451 tgcctcagca tcccaaagtg ttgggattac aggcatgagc caccacacct
274501 ggccggtaat tctatttta actcttttat ggaactgcca aactgtttcc
274551 aaagtggcta tactacactc ccacaacaac acacagggat tccagcttct
274601 cggagtcctg gccattcctt gttattttcc aacttttga taatagcctt
274651 cctaatggt atgaagtaga aaaaaaatt ccattttttc aacagatgc
274701 tgcaacctgg ccgttggccg atacctttg tttggccttg aatagtttta
274751 tacgtaggag ccaatacttt gaaaccagca tattttacag ggagagagag
274801 agagagtgag caagcaggag ctggcttctt ttgaaaaatc atatggaaac
274851 tctgagccca cattcttgaa cctgtgaatg agaggtagtt gcccttgagg
274901 tgggggcaag ggccacgtgc ttccctccgg acacacatgg aaattgtaca
274951 ggatactggg gaagtgaaga gggacgtgct cagctcagct cagctcagca
275001 ctggctgtcc cgcacacctg cacttgaggg ttgggttggg gtccgggcag
275051 tgtctgacct ggtggcctcc caccctcccc acttccccca actcacagga
275101 ctaagccaat gcgcgtgccc tctgcctcat tgtttatcgt gtctccctgc
275151 cctcatgggt ctttgagttt gagacactct gtgcaagaac taagcctgtg
275201 acaagagcgc ttctgtcgac tactctgtca ttagcaaggg tagaggccac
275251 aggaatagt tcattagttc cttcactttc atcctccct gcaccaacac
275301 aatctatcct gcaattaagg gaaagaaacc cagggaaggg accttggtgg
275351 cctccatgga aagcccttgt cagccagtgg agatgggaca ttgagttgca
```

FIG. 7 CONT'D

```
275401 atctagagtg actggagtga tagtagtgag acataataat aacaggaaga
275451 catagcaaga cattgtctct acaaaaaaaa aaacaaaaca aaaaaacaaa
275501 aaaaactggg tgatgttgac ttgatcacca gttgattatt tcttacttct
275551 tggacccaac atatattgag cacctgccat gtaccaagca cttggctagg
275601 ctctgggaac acagcatggt tcctgctctg ttccaggagg atttgggagc
275651 tcttgagaca ctgagcttgg ttgagtcatt attttattca tcatgaaatc
275701 actagaaaaa gatggaaact tgaactgcaa acattgcttg gatttatatt
275751 ctaaggcact ggttctcaaa cctgaatggg cttcagaatg acctggtggg
275801 cttgttaaga cataggatgc tgccacctcc caacccacc  accaatacag
275851 tttctggttg agtagctctg gttcagggcc taataactga catttctttt
275901 tttcttttct ttttttcttt tttttttttt tgaggcaggg tctccctctg
275951 ttgcccaggc tgagtacagt agtgcaatca tggctcactg caaccttgaa
276001 ctcccaggtt ttattgatcc tcccacctca gcctcccagg tagctgggat
276051 tacaggtgtg agccaccaca cctggcctga taattggcac ttctaacaag
276101 ttatcaggtg atgctgatgc tgctggtcca gggacacact ttgagatcca
276151 ctgttccacg aaaattatgc cagggctggt ctaagaatat tcccttcct
276201 tcatttgttc tccttaacca atcatcctga cccatacggc agccattgct
276251 gttagatgtt actggaagat tgaaatgact ggctgtctcc atcgcaaacc
276301 tgaataattg tagggctaga aatgagctat ccctttggct gggctgcggc
276351 ttggggaagt aattacctca gaataacgaa gcagtcactt ccagagtcat
276401 tacttctgca tgcagagatg gttcaagaat ccttggagaa accctatcaa
276451 gtcctggcct acttgaagtc agtattgagg cttccctgg  cagtgaaact
276501 actgaggcca agattgcttt cccaagctgg aaaaaacggc atcccagatg
276551 accaccctgt tcctgcagac acacatctgg gcttctagcc actgggggca
276601 ccagaggctc accgttttaa cttttctga  gcaaccaagc tgctctcagc
276651 ttgttgattc aagaacactc aacctgaaaa gtctacaggc tcttatttaa
276701 aatttgtccc aatcaagaaa caagtattat tattttgtgt attcctgaag
276751 tctatgctag aaatggagga gaatgggagg aacccgcaat caactgtcca
276801 ttgtgggtgt agattagtat ctgcagccac atgggtgatt ttttttttta
276851 cttgcagtta gcatttgtcc taatttgaga gaaatcagga ccttcatggt
276901 ggcataatca taaacaacgt tttacttaaa gcagtggttc tcagcgttga
276951 ttgaacattg gaatcaccta gctttataaa ggattgaaac tgatagccaa
277001 agctgggacg agttaagcaa caaaattaat aaaatagtat tggacccaac
277051 atataaataa atatcaatga gttcatacta acataaatat acaattaaat
277101 taattaatta tttaatttgt ggtgggagaa ttcctaataa tgtgcacaag
277151 aattccaaat aatgtatgta gatactccac cctcaaggag ctagagcaca
277201 actccctata actaaagtgt gagtagcaaa cagtgactct cttccaaaga
277251 ttacagtatg gaaaggggag aaaagtaact ttccaatgga gacatcttag
277301 ccaggtgttc aagtcagcat cagtagtggt gaatcatgtt gattgtatgt
277351 actcttgaca tgatgtgatg acaatggcac tttacctctg tgctcttcct
277401 cccaaaagcc catggccctg tctaatcatg agacatcaga cagatcccaa
277451 ccgagggata ttctacaaaa tattcgacca atactcctca aaaatttcaa
277501 gaccatcaaa aacaagaaaa gcctaagaaa ctgtcacagc caagaagggc
277551 ctaaggagac atgatggcta aatgtcatgt gggttcttgg atgggacctt
277601 ggaacagaaa aagaatgtta ggaaaaaact aaagtagtct gaataaagta
277651 tggactttag ttaatagtaa tgtctcaaca ttgattaatt gtgacaaatt
277701 tgcgatgcta atgtgagatg ttaataattg ggggaaatgg gtgtggagta
277751 tatgggaaac tctctgtacc atctttgcaa tttctctata tatctaaagc
277801 tattctaaaa tttaaaagtt ttctcagcgg ctgtttagct taatcggtta
277851 aagcatggtg ctgataaaat tttaaagttt attataaaga aaaacattg
277901 atccatggaa tccacccccg gtccctcag  gggttcaaat ttaactagtc
277951 cagaatttgg ccttggcttt gggctattat aggcagccag ggttaagaac
278001 catacttca gtgttaatca aagccgtctg aaaagttagc atattcttgc
278051 cttatccctt tttctcacac acctcaaact attcttttgg ttccatgaaa
278101 aaaatgttgt tttataattt tctttctttc tttttttttt ttttgagat
278151 ggaatcttgc tctgttgccc aggctggagt acagtggtgc aatcttggct
278201 cactgcaact tccacctcct gggttcaagc gtttctccta cctcagcctc
278251 ctgagtagct gggattacag gcatgtgcca tcacgcctgg ctgattttg
```

FIG. 7 CONT'D

```
278301 tattttagt agacacgggg tttcgccatg ttggccaggc tggtctcgaa
278351 cttctgacct caagtgatgc acccaccttg gcctcccaaa gtgatgagat
278401 tacaggcgaa agccactacg cctggcctgt gttattattt tcttgaatag
278451 cgttatgggt tgacttttga gtctcccaca aagatatgtt ggagtcctaa
278501 cccccaattc cttaaaatgt gacctcattt ggagataggg gctttgtaga
278551 tgatcaagtt aaatgaggtc cttagggtaa gccataatcc aatgtgaaaa
278601 gtgtccttat aaaaggtga aatttgatac agagacagac agacatgtgt
278651 ccaggggaga caatgtaaag acagggacaa atcatctaca ccatcaggga
278701 gagaggcctg gaccagaccc ttctctcaca gccctcagga agggcctgtc
278751 gacaccttga tttcgtacgt ctagctctgg gaatgtgaca ataaatttct
278801 gttgtttgag ccactcaatt tgttacacca ttcccttcaa gactaataca
278851 tatagtattt gcattcttct ggaatatgtt atggcttcat aaacatacat
278901 aaatatagac atgatttcaa gggatcaaat tatgcataat aacattatag
278951 tatcaatttt cctttcgtat gatgcagtcc tttgtggaag gacatgtgaa
279001 tggtttctct aaactgtgac ctcctcaagg gcagctctgc atctccatgg
279051 ccagcattat gtaacactgt ggttccagcc tcaggagcag aagcagggaa
279101 gggtggtggc ttggagctct ggtgatggaa ggagggctcc cttctgtatg
279151 tgcaagccca ggcttttttt ggtgggaagc atggtctcaa agggagtgga
279201 gtgaccacct ggagaaataa gagatggact gttacatatt gcagattgac
279251 aaagaaggcc atactggttt tatgtaattt tctctctctt tccacaatta
279301 atatacagct gttttggca acagctttat tgatatctaa tttacatacc
279351 atatatttta cttgcttaac gactacaatt tggccaggtg tggtggctca
279401 cgcctgtaat cccagcactt tggaagcaga ggtgggcgga tcgcttgagc
279451 cgaggagctc cagaccagcc tgggcagcat ggcaaaactg tctctacaaa
279501 aaatataaaa attagccaaa tatggtggtg gtgtgcacat gtagtcccag
279551 ctacttgaga ggctgaggtg gcaggatcac ttaaacccag aaggtcgagg
279601 ctatggtaag gtgtaatcat accattgcac tttagcctag caacagagt
279651 gagaccctgt ctcaaaaaaa aaaaaaaaa agaaaaagaa aaagaaaaaa
279701 gagcacaatt ccatggtttt tagtattaat atattcacag agttgtgcaa
279751 ccatcaccac aattttagaa tatttgcatc acagcagaaa gaaatccata
279801 cccatttcca atcacctctc atttccaatc tccctagccc tgggaaacca
279851 ctaattttt tttttttttt tttttttga gatggagtct cactctgtcg
279901 cccaggctgg agtgcagtgg caccatcttg gctcactgaa acctccatct
279951 cctgggctcc agtgattctg ctgtctcagc ctccctagta gctgggatta
280001 caggcatgca ccaccacacc aggctaattt gtttgtattt ttagtagaga
280051 tggggtttca ccatgttggc caggctggtc tcaaactcct gacctcaagt
280101 gatccacctg ccttggcccc tcaaagtgcc gggattacag gtgggagaca
280151 ctgcacccgg ccagaaacaa ctaatctatt atttgtttct atagatttgt
280201 ctgtttggga catttcatgt aactagaatc atacagaatg tggttctttg
280251 cgattggctt ctttcaggca gcatgatgtt ttcaaggtcc atccatgtgg
280301 tagcaggtat cagtgcttca tttctttta ctgccaaaaa atattaaatt
280351 gacttgtata caccacactt tatttatcca ttcacctttg aattgtttca
280401 aagttttgac tatcatgaat aatgttgtca tgtacatttc atatacaagt
280451 ttctgtgtgg acatatgttt ttatttctct tgggtgcata cttaggagta
280501 gaattgctgg ctcatatgtt aactctttgt taacatacag aaactgtcag
280551 actgtgtttt caaaacagtg caccatttg tattcctacc attagtgtat
280601 gagggttcta cttttccat atcctcacca acaattgtta ttatctgcct
280651 ttttgattat aaccaacgta gtgagtgtga agtggtattt cattgtggtt
280701 ttgatttgtg tttctctgat ggctaattct ataacatttt ataatcagaa
280751 taaaataagt tctattctaa aaaatagcaa cgacagcaat tcttctttag
280801 gtaagacatt gtctgtgttc cagtttctc tgacaatctg tgacccagta
280851 gtctcacaga cagtccttt ggataaacat agaaatttac ccctctggtc
280901 ttaaacttat atttgtttta tctgagttcc ttcttcagga aaggacaccc
280951 aggactctca aaaactatca aagaactggc tgtctgcggt ggctcatgcc
281001 tgtaatccca gcactttggg aggccaaggc gggcgaatca cgaggtcagg
281051 agatcgagac catcctcgcc aacacagtga aaccccatct ctactaaaaa
281101 tacaaagaat tatctgggct tggtggcaga cacctgtagt cccagctact
281151 caggaggctg aggcaggaga atgtcatgaa cccgggaggc agagcttgca
```

FIG. 7 CONT'D

```
281201 gtgagccgag atcacgccac tgcactccag cctgggtgac agagtgagac
281251 tccatctcaa aaaaaaaaaa aaaaagtttc aagaactga aactcaccag
281301 atgatcccca catccagaaa gtgagatgat ctcatgcgtc attaatcatg
281351 attgctttct tactcctccc tagttcctgt tttcccacac attgctaaat
281401 ttcttccctg ccatataaac ctctaatttt aattggtcag ggaaatggat
281451 ttgagactga cctccatct ccttggctgt agcacccgat taaagccttc
281501 ttccttggca atactcatca tctcagtcat tggctttctg tagggggagc
281551 agcaggacct aaactaaacc ctgctgtttc ggtaacagat tttggttccc
281601 tgaccaggaa cacattgctc atggtttggc tgctgcaggc caggaatctc
281651 agaagccatc ctaagcagct gcccacccaa ttttgtctgg aggtgagttt
281701 tggtctccct ctggccctgc tgctgacccc aactgtgttc ctgattgcct
281751 agaaagagca tcctttgaaa tttgacatct gcatccacat gggatagtgt
281801 cctttgtggg tcctgatagc aggatctgct cctctcaatt tgggaaatat
281851 ttatagaaat ttccatttgc aggttgaaca agcccaactg acttgagaga
281901 agcaccctga ctgtttcagt gtagacattc ttggggctt gtttgtaatt
281951 gtgtgttttg tgtgtgtgtg tgtgtgtgtg tgtgtgtgta tgtgtgtgtg
282001 tccaggcaag tgagtgtctt gcaggtacca cacagcagga ttggatcctc
282051 tcaatttgaa aaatttcaaa ggaattttat ttgcaggttg atcaagccca
282101 accaatagag agaggaagca ccccaaatgt ttcagcttgg acactcttgg
282151 ggcttgttta ttgctgtagc atttgaattg tgttttggtg attgtgtgtg
282201 tgccatggga aatcagaatt caataaactg aaattctttt gtaatactgt
282251 ttgaccccaa tattgtttgg aatctggagt ttgctgttga atgggaaagt
282301 gggatggagt tctgtgtatc caggcttttg tgctgctgtt ctaagcagag
282351 ttgggcctgg ttatttattt atttattttt gagatggagt ctcgctgtgt
282401 tacccaggct ggagtgcagt agtgtgatct cagctcactg caacctccac
282451 ttcatgagtt caagtgattc tcctgcctca gcctcctgag tagctgggat
282501 tacagttgcg ctccaccaca cctggcttat tttttttttt tttgagacgg
282551 agtctcgctc tgtcgcccag gctggagtgc agtggcgcaa tctcagctca
282601 ctgcaagctc cgcctcctgg gttcacacca ttcttctgcc tcagcctccc
282651 gagtagctgg gactacaggc gcctgccacc atgcctggct aatttttgt
282701 attttcagta gagacggggt ttcactgtgt tagccaggat ggtctcgaac
282751 tcctgacctc aagtgatcca cccgcctcgg cctcccaaag tgctgggatt
282801 acaggcgtga gccactgtgc ccggcctaca cctggcttat ttttgtattt
282851 ttagtagaga tggggtttca ccatgttggt caggctagtc tcaaactcct
282901 gacctcgtga tccactcatc tcagcctccc acagtgctgg aatacaggt
282951 gtgagccacc acgcccagcc ttgggcctgg ttatcatgcg atgttctccc
283001 atggtgctgt ttggcttcag tgttctttgg agtctggaga ggtttggcct
283051 ttaaaaaaca aattgccatg gaaactgctt tacccacaat tttggttcac
283101 agccttcact ggattgccta tccagtcaaa caaagtgtag ccacataaac
283151 tggtgatttg tattgctatc ttatggctac agttcaaagg caaaggctat
283201 tgtatctttg tttatatatg tgtgtataca tgtctatata tgtttatgta
283251 tgtacgttat atgttgtgtc taccaaattg cttataaat acaaaaaact
283301 catatattaa gtccaaagtc ttttcaagt tcacaagact tacataaacc
283351 tttaataaag aagctggctt taaaattact gataaaataa agtagaagg
283401 gtcttcagaa ttgtcagcat acatttttgt ctaggtttta tatttgtctc
283451 tgctagatgt tttgaggtgt cagggtttgg cacagaaggt tataaaactg
283501 aacccagctg gaataaacaa aataatcttc gtttgtgtgc cttctttgac
283551 aaaagagatc aatttaatgt tgttagctga atcttctgag ttattggcaa
283601 aaaatactta tgtatttaac tttaagtttc ttacttagat cctggctatt
283651 taaaaaatg gttagctgga tgcggtggct tacacttgta atcctagcac
283701 tttgggaggc tgaggtggc agatcacgag gtcaggagtt cgagaccagc
283751 ctggccaaca cagtgaagcc ccatctttaa aaaaaatac aaaaattagc
283801 tgggcatggt ggcagtggcc tgtaatccca gatacttggg aggctgaggc
283851 aggagaatca cttaaaccca ggaggtggag gttgcacttc agcctgggtg
283901 acagagctag actctatctc aaaaaaataa aaataaaaaa taaaaatgg
283951 aaattacttt gattgatgac tagttgtgtc ttatatctca gttttcagaa
284001 gtaatctaga tgaacttaaa aaatgaaatg attgagtaca tgtaaatggg
284051 atacatgtta taggtaaaca ttttgtataa tttaaaatct taaaattatt
```

FIG. 7 CONT'D

```
284101 tttgatgctt attggatatc tgattcattt ccaattaata aatggttatg
284151 atatgggaaa aaataatttt acaaattgtg gattagttct catctatcaa
284201 atgctgatat ctgataagca gctcaggatt tcctacttcc taggttttt
284251 cactaaaatt taaggttact aagaataaga attctagtta atatataatt
284301 ctgtatataa agtgtgccaa aaaagatgtg tttttattga gaaaaagaat
284351 cattttgtct ggttcagaag ttatctaaag gttaattcaa attatgggtt
284401 tgaaaatgtt atttatgaaa caaggtagaa agtaaccagt aagtacagga
284451 gagagatgtg aacaaagtta tggatatgaa gatgtatttt tggtataggt
284501 tctaaagaaa agattccaaa gaaaatagaa taattatgta tgaaaaagga
284551 tcttgtatgg caaattttg tcctaaagta aaatgactgg ttatttaaaa
284601 aaaaaaacaa aaaaacaaaa cagaaagaaa aagggaaaat gtagaacaaa
284651 acagaaagtc caagcatgtc acagatggtc tgtgtaagtc atacgttgtc
284701 tgtgtgtctc tcttcatgca aatattcttt aaaacctgat agaaaattgg
284751 agaaatttgg ctaattaaca ttgcttatag ttaaatcttg tagtcttgat
284801 gaaggtaaaa taagaaatat aggaaatatt gtaaagaaat acattggtag
284851 tttggcaatt ttaaaaaata tagttaagca tgaagccaga tttagcgtag
284901 aaccacatct cacatacatg cttgcattga ttcacactac atttgctgtt
284951 ctgcagatag ggctagcact aaagtataat actggtcatg tactgagaat
285001 gaatttctgt tctttgttat ttttttttc tgtgagacgg agtctcactc
285051 tgtcacctag gctggagtgc agtggcaaga tctcagatca ctgcaacctc
285101 tgcctctgtg attcatgtga ttctcctgcc tcagcatccc aagtagctgg
285151 gattatagga gcacaccacc atgcctggct aattttgta ttttcagtag
285201 agatggggtt ttaccatgtt ggctaggctg gtctcaaatg cctgcctggg
285251 cctcccaaag tgctgggatt acaggcgtca gccactgcac ctgacctaaa
285301 gtgaatttcc taattgcaca aatgtatgg tagtattggt ggccttaaag
285351 acattaaatt gcatatcagg aagaaaatat tcgtcatgcg atttttttt
285401 ttttttttt ttttggctct gagtaacact gtagcctcca aggtaaactg
285451 agtataagaa aaattttggg ttggtttcct gtttatttct tttgcttcta
285501 attttattt gctgtttgtt tgcttttggg ttttacttat acatacatat
285551 atataaaatg attgactttt taaaattcta gtggaaggct tttatttggt
285601 tctatgaaca atcatttgt ttcctatgca tttccagcaa ttcaccattt
285651 gccctgttta tcctaagcta cctttgtcaa gcctccaaaa attgatagag
285701 gatactagcc atttaaaatt tgaggccagt ccagcacagc acagcgcggc
285751 ccgcaggagc ctggcctgaa catgtgccca ccagacctcc aaacttgagc
285801 caccatctct gcccatccct agggagccta agccctgca gcacccctcc
285851 cacctgtctc cagccatggg tgatgttgat gctgctgttt tggagacaac
285901 actctaagca tgtgtgcttc caattgtgag tctgtgaact ctgtaaagag
285951 acagaaaatc gattcccagg caagatgggc gaataggaac agctctggtc
286001 tgcagttccc aacgagacca acatggaagg tgggtgattc ctgcatttcc
286051 aactgaggta ctcagctcat ctcactggga ctggttagaa cgtgggagca
286101 gcgcatggag ggcaagcaga atcagggtga ggtatttcct cacccagaaa
286151 gtgcaagggg ttggggaact ccctcccata gccaagggaa gctgtgagtg
286201 agggatggtg ttacttggcc cagatactat gcttttccca ctctcttcac
286251 aactcacaga ccaggagatt cccttgggta cctacaccac cagggccctg
286301 ggtttcaagc acaaaactgg gtggccattt gggcagacac tgagctagct
286351 gcaggagttt tgtttcgtat cccaatggtg tgtggaatgc cagtgagaca
286401 gaactgttca ctcccctgaa gaggggctg aagccaggaa gctgagtggt
286451 cttgctcagc ggatctcacc ctcacagagc ccaacaagct aagatccact
286501 ggcttgaaat tcttgctgcc agcacagcag tctgaagtcg acctgggatg
286551 ctcgagcttg gtgggggtag ggatgtccac cattattgaa gctcgagtag
286601 gtggttttcc cctcacagtg taaacaaagc ctccaggaag tttggactgg
286651 gcagagccca ccacaatgcc acaaagtcac tgtagccaga ctgcctctat
286701 agattcctca tctctgggca gggcatctct gaaagaaatg ccgcagcctt
286751 agtcaggggc ttatagataa aatccccatc tccctgggac agagcacctg
286801 ggggaagggg cagctgtgcg tgcagcttca gcagacttaa atgttcctgc
286851 ctgccagctc tgaaaaaagc agcagatcac ttgacacagt gctcaagctc
286901 ctgctgaggg acagactgcc tcctcaagtg agtccctgac ccccgtgctt
286951 cttgatgggg ggacacctcc cagcagggt tgagagacac ctcatacagg
```

```
287001 agagctctgg ctgccatctg gcaggtgccc ctctgggaca aagcttccag
287051 aggcagaagc aggcagcaat ctttgctgtt ttgcagcctc cgctggtgat
287101 acccaggcaa acagggtctg gagtggacct ccggcaaact ccaaaaaacc
287151 tgcagaagag gggcctgact gttagaagga aaactaataa agagaaagca
287201 atagcatcaa catcaacaaa aaggatgacc acacaaaaac cccatccaaa
287251 ggtcaccaac atcaaagacg aaaggtagat aaatccgtga agataaggaa
287301 aaaccagtgc aaaaagactg aaaattccaa aaaccagaat gtctcttctc
287351 cttcaaagga tcacaacttc tcaccagcaa gggaacaaaa gtggatggag
287401 aatgagtctg aggaagtgac agaagtaggc ttcagaaggt gggtaataac
287451 aaactcctct gagctaaagg agcatgttct aacccaatgc taagaacctt
287501 gctaggaagc taagaacctt gataaaggt tacaggaact actaactaga
287551 ataatcaatt tatgggctag gcacagtggc tcacgcctgt aattctagca
287601 cttagggagg ctgaggtggg tggatcatga ggtcaggagt tcgagatcag
287651 cctaaccaac acgatgaaac cctgtccta ctaaaaatac aaaaattagc
287701 tgggtgtggt ggcacgtgcc tgtagtccca cctactcagg aggctgaggc
287751 aggagaattg cttgaaccca ggaggcggag gttgcagtga ccaagatct
287801 tgccactgca ctccagcctg tgtgacagag caagactcca tctcaaaaaa
287851 ataaataaat aaaaatagaa taaccagttt agagaagaac ataaatgacc
287901 tgatggagct gaaaaacaca gcatgagaac ttcgtgaagc atacacaagt
287951 atcaatagcc aaatcgatca agcagaagaa aggatatcag agattgaaga
288001 tcaacttaat gaaataaagc atgaagacaa gattagagaa aaagaatga
288051 aaaagaatga acaaagtctc caagaaatat ggggctatat gaaaagacca
288101 aacctatgtt tgattggtgt actgaaagtg atggggagaa tggaaccaag
288151 ttggaaaaca cacttcagga tattatccag gagaaattcc ccaacctagc
288201 aagacaggcc aatgttcaaa ttgaggaaat acagagaaca ccacaaagat
288251 actccttgag aagagcaacc ccaagacaca taattgtcag attcaccaag
288301 gttgaaatga aggaaaaaat gttaagggca gccagagaga aaggttgggt
288351 tacacacaaa gggaagccca tcagactaat agtggatctc tctgcagaaa
288401 ccctagaagt gagaagagag tgagggccaa cactgaacat ttttaaagaa
288451 aagaattttc aacccagaat ttcatatcca gccaaactaa gcttcataag
288501 tgaaggagaa ataaaatcct ttacagagaa gcaaatgctg agggatttta
288551 tcaccaccag gcctgcctca caagagctcc tgaaggaagc acgaaatatg
288601 gaaaggaaaa accagtacca gccactccaa aaacatacca aaatgtaaag
288651 gccatcaaca ctgtgaagaa actgcatcaa ctaatgggca aaataacaag
288701 ctggcaacat aatgacagga tcaaattcac acaaaacaat attaacctta
288751 aatgtaaact ggctaaatgc cccaattaaa agacacagac tgacaaattg
288801 gataaagagt caagacctat caatgtgctg tattcaggag acccatctca
288851 tgtgcaaaga cacacatagg ctcaaaataa agggatggag gaagatttac
288901 cgagcaaata gaaagcaaaa aaaaaaaaaa aaaaaaagca ggattgcaat
288951 cctagtctct gataaaacag actttaaacc aacaaagatc aaaaaagaca
289001 aagaagggca ttacataacg gtaaagggat caatgcaaca agaagagcta
289051 actatcctaa atatgtatgc acccaataca ggagcaccca gattcataaa
289101 gcaagttctt agagacctgc aaagagactt agactcccac acaataatag
289151 tgggagactc taacactcca ccgtcaatat tagacagatc aatgagacag
289201 aaaattaaca aggatattca ggacttgaac tcagctctgg accaagcaga
289251 cctaatagac atctacagaa ctctccaccc caaatcaaca gactatacat
289301 tcttctcagc accacatagc acttattcta aaattcacca cataatttga
289351 agtgaagtac tcttcagcaa atgcaaaagt acagaaatca taacaaacaa
289401 tctctcagac cacagtgcaa tcaaattaga actcaggatt aagaaactaa
289451 ctcaaaactg cacaaataca tggaaactga acaagctgct cctgaatgac
289501 tactgggtat ataatgaaat taaggcagaa ataaataagt tctttgaaac
289551 taatgagaaa aaagacacaa tgtaccagaa tctctggac acagctaaaa
289601 cagtgtttag aggaaaattt atagcactaa atgcccacag gagaaagtag
289651 gaaggatcta aaatggacac cctaacatca caatgaaaag aactagagaa
289701 gcaagagaaa acaaattcaa aagctagcag aagatgagaa ataactcaga
289751 tcagagcaga actgaaggag atagagacac aaaaaacccct tcaaaaaatc
289801 gatgaatcca ggaactggtt ttttgaaaag attaacaaaa tagatagacc
289851 gctagccaga ctaataaaga agaaacagag gaagaatcaa atagacacaa
```

```
289901 taaaaactga taaaggggat gtcaccactg atcccacaga aatacaaact
289951 accgtcaaag aatactataa acacctctat gcaaataaac tagaaaatct
290001 agaaatggat aaattcctag acccatacac cctcccaaga ctaaaccagg
290051 aagaagttga atccctgaat agactaataa caagttctga aattgaggct
290101 gtaattaata gcctaccaac caaaaaaagc ccaggaccag acagattcac
290151 agccaaattc taccagaggt acaaagagga gctggcacca ttccttctgt
290201 aactattcca aacagtagaa aaagagggac tcctccctaa ctcattttat
290251 gaggccagca tcttcctcat atcaaaacct ggcagagaca caacaaaaaa
290301 agaaaatttc aggccaatat ccctgatgaa catcaattag aaaatcctca
290351 atgaaatact gccaaactga atccagcagc acattaaaaa gcttatccac
290401 cacaatgaag tcggcttcat ccctgggatg caagcctggt tcaacatata
290451 ctaatcaata tatataatcc atcacataaa cagaaccaat gacaaaaacc
290501 acatgattat ctcaatagat gcagaaaaga cctttgataa aattcaacac
290551 cccttcatgc taaaaactca ataaactagg tattgatgga acgtatctca
290601 aaataataag agctatttaa gacaaactca cagccaatat catactgaat
290651 gggcaaaagc tggaagcatt cttttgaaa actggcacaa gacaagatca
290701 ctcctattca acgtagtact gggagttctg gccagggcaa tcaggcaaga
290751 gaaagaaaga aattgtattc aaataggaag agagggagtc aaattatctc
290801 tgtttgcaga tgacatgatt gtatatttag aaaagcccat cgtctcagcc
290851 caaaatctcc ttaagctgat aagcaacttc agcaaagtct caggatacaa
290901 aatcaatgtg caaaagtcac aagcattcct atacaccaat aacagacaaa
290951 cagagagcca aatcatgagt gaactcccat tcacaattgc tacaaagaga
291001 ataaaatatc taggaataca acttacaagg gatgtgaagg acctcttcaa
291051 gaagaactac aaaccactgc tcaaggaaat aagagaggac acaaacaaat
291101 gggaaaacat tccatgctca tggataggaa gaatcaatat agtgacaatg
291151 gccatactgc ccaaagtaat ctatagattc aatgctagtc ccatcaagct
291201 gccattgact ttcttcacag aattagaaaa atctacttta aatttcatat
291251 ggaatcaaac agagcccata aaggcaaggc aatcctaagc aaaaagaaca
291301 aagctggagg catcatgcta cctgacttca aactatgcta caaggctaca
291351 ggaaccaaaa cagcatggta ctggtaccaa aacggatata tagaccaatg
291401 gaacagaaca gaggcctcaa aaataacact acacatctac actcatctga
291451 tctttgacaa acctgacaaa aacaagcaat ggggaaagga ttccctattt
291501 aataaatggt atcgggaaaa ctggctagcc atatgcagaa aactgaaaca
291551 ccttatacaa aaattaactc gagatggatt aaatatttaa acataagacc
291601 taaaaccata aaagccctag aagaaaacct aggcaatacc attcaggaca
291651 tgggcaaaga cttcatgact aaaacgccaa aagcaatggg aacaaaagcc
291701 aaaactgaca aatgggatct aattaaacta aagagcttct gcacagcaaa
291751 ataaactatc atcagagtga acaggcaacc tacagaatgg gagaaaagtt
291801 ttgcaatcta tccatctgac aaagggctaa tatacagaat ctacaaggaa
291851 tgtaaacaaa tttacaagaa aaaaccaaa caatcccatc aaaaagtgga
291901 tgaaggatat gaacagacac ttttcaaaag aagacattta ggcagccaac
291951 aaacgtgaaa aaagctcat aatcactggt cattagagaa acgcaaatca
292001 aaatcacaat gagataccat ctcacgccag ttagaatggc gatcattaaa
292051 aagtcaggaa acaacagatg ctggaagga tgtggagaaa tgggaacgct
292101 tttacactgt tggtgggagt gtaaactagt tcagccattg tggaagatgg
292151 tgtggtgatt cctcaaggat ctagaaccag aaataccatt tgaaccagca
292201 atcccattac tgggtatata cccaaaggat tataaatcat tctattataa
292251 agacacatgc acacatatgt ttattgcagc actattcaaa atagcaaaga
292301 cttggaaccc acccaaatgc ccatcaatga tagactggat aaagaaaacg
292351 tggcacatac acaccatgga atactttgca gcataatga gttcatgtcc
292401 tttgcaggga catggatgaa cctggaaacc atcattctca gcaaactaac
292451 acaggaacag aaaccaaac accgcatgtt ctcattcata gtgggagtc
292501 gaacagtaag aacatatagg gacagggagg agattttcac acactgggc
292551 ctgttggggg atgggggca aggggaggg aatatcacac actgggcct
292601 gttgggcat gggggcaag ggagggaaa gcattagggg aaataccctaa
292651 tgtagatgat gggttgatgg gtatagcaag ccaccacggc acatgtatac
292701 ctatgtaaca aacctgcata ttctgcacat gtatcccaga atttaaagta
292751 taaaaacatt tttttgattg gctttgctga tgatcttgag atctatgaga
```

FIG. 7 CONT'D

```
292801 gccttaagtt tcttggcaaa taaataaata aataaaagac atttttata
292851 aggtttgaac agatagtaca tttattttgt tgtttgaaaa gataggtgag
292901 aattaaaatg tttaaatggt gtttatttcc aaggtgattc ttttcattat
292951 tattactatt attattatta ttattagaga tattgtcttg cttagtctcc
293001 caggctgaac tggactgcag tggtgcaatc tcagctcatt gcgacttgcc
293051 ctctcaggtt caatcgattc tcgtgcctca gcctcttgag tagctgggat
293101 tacaggcgtg caccaccatg ccctctaatt ttttattt tagtagggac
293151 gaggttttgc catgttggcc aggctggtct tgaactcctg acctcaaatg
293201 gtccacctgc tttggcctcc caaagtgctg agattacacg catgagccac
293251 catgtccagc ctatttccaa ggtaattcaa tgaaatcaat aatttgagtt
293301 ggtttcagat ctttttcttt aatgaggaaa aactgtgata tgggtacaaa
293351 attttaatgc tcaggaaaaa ttggccttgt ccttacggaa attatattga
293401 ttgagatttc tttcaaacta ctttaattgt gtttactatt attaacatta
293451 agtgccgggc gcggtggctc acgcctgtaa tcccagcact ttgggaggcc
293501 gaggtgggtg gatcacctga ggtcaggagt tcgagaccag cctgaccaaa
293551 atggcccgtc tctactaaaa acacaaaaat tagctgggcg tggtagcaga
293601 cgcctgcaat cccagctact caggaggccg aggcaggaga gtcacttgga
293651 cccgggaggt ggaggttgca gtgagcgag attgcgccat tgcactccag
293701 cctgggtgac agagccatac tccatctcag aaaaaaaaaa aaagacacag
293751 ggccagaaat taaaactact caatccctct aggctgaggg actactgcag
293801 aagaggtagg cacatgagat tgtaatggcc ggttttgagg gataagatta
293851 gttcagggcc aggtgccatg gctcatgcct caatcccagc acttggggag
293901 gctgaggtgg gtggatcaca aggtcaggag atcaatacca tcctggctaa
293951 caccatgaaa ccccatctct actaaaaata caaaaaaatt agccgggcgt
294001 ggtggcaggc acctgtggtc ccagctactc gggaggctga ggcaggagaa
294051 tggcatgaat ctgggaggca gagcttgcag tgagccaaga tcatgccact
294101 gcactccagc ctgggtgaca gagcgagact ctgtctcaaa aaaaaaaaaa
294151 agaagatta tttcagtttt tctataaatt aaacattaac accaaaacca
294201 cactgatgca aggccagcat ctgggacttc ctggagcatt aatctgctcc
294251 ttaatagaaa attgtaaaag attataaaaa gtttatggaa atcttacctt
294301 atggtcaaac tgattacaat tggatagatt tgtttataag gttttattaa
294351 aattagtttt aacattaata atataccata taaggtaaa atttggtttc
294401 ccttgaacaa aatgttcatg taagagataa gagattttg agtaaaacta
294451 cagaaaaaga gagggttctt tccctcctag ttggcttcat gctgttttta
294501 ttagggctta ttgttggga agctgagtct cctcactatc aaagggtaac
294551 ctgttttgta ttatcatttt tgctaaacga atggctattt tatagtgacc
294601 tataatccta ttttgtgatg tcaagtgtct taaaactgat ctctgacaaa
294651 ctttccaatg gcaaaatttc aagctctaaa ttcagtcttt ttgacctcaa
294701 agtaacttt ttgggtataa gtttccctga cgtccaagag agacatatta
294751 ggtttatttg gcttatttgt tatgttagaa ttatgcagga agcattgtca
294801 atctgaggtg gtgttcagct tcctttgggt tttattat tatttattta
294851 ttatttattt tttagatggg tcttgctctg ttgcccaggc tggagtgcag
294901 tggcacaatc tcagctcact gcagcctctg cctcccagat tcaagtgatt
294951 tttgtgcctc aggcttccaa gtagctggga ttacaggcat gtatcaccat
295001 gcccagctaa ttttgtatt tttagtggag ataaggtttc gccatgttgg
295051 ccaggctggt cttgaactcc tgacctcagg tgatccacct gccttggcct
295101 cctggagttc caggatgata tgagagtct aaaattctga tatgtcttaa
295151 tatatgttgt cacagtaatt attattatga tgttaacttg tatgccacag
295201 gaataacaaa atacccctagt taactgtgcc tttaactatg gctgtcttaa
295251 aacttttgtc atccacaatt gtagtttgc tttgatcctt ctcaaaaagt
295301 gacttataat cagctacagt ccagggcttt cttctttggg gaagtttatg
295351 aaaaattcaa cctctcaaat gcaggttttct tataactttg tagactgtgc
295401 cattggatta gagagaaaac ttccagggca ctaattgaaa tgctgatatg
295451 ttcataaaga ttgctaactc aatatgaagc ataccagaag ttgattgcat
295501 ggactgaatt aatgagagct gaaataattt tttatggttt ttttgtttga
295551 aatattgctg attcttttg ttttgttttt cagagtctgg agaatttttt
295601 tctttggagc ttttattgc ctctgagtat actttaagta tattgaatac
295651 agtatgcttt cctcaaacag aatttgaggc atagttctct ctatgcctaa
```

FIG. 7 CONT'D

```
295701 tttatccaga atttgtaaat tatttgtgaa tattcttaat tcatggcaat
295751 gtgtttgctt gcataagttc aataagaatc tattttattt tatactgcga
295801 cacagatgga tgaactggct attttcccag gtctttgact gaaatggcct
295851 tgtgagaggt tccagcaagg ccaatttagg agagcctatg tggacagcaa
295901 ttcttgctgc actttgtggg gtaatcaagc cacgtttatg ggattgcagc
295951 ttatttcgca ggtaggtttg tcttgctgag atttgtcttt ggtggaagta
296001 ggggactgga aaaagaaaga ttgtttcaga agaaaaggat agtattagat
296051 taacctttga ttcctggggg gccacagagt cacccatggt atgaggctgc
296101 ccaggatgcc cctcatcaat atcaagcagc cagaatgatc aacaagattc
296151 cccatgaatg aggaattgat atttatgtat atactatatt attcttttt
296201 taagatgggg tctcactcta tcacccaggc tggaatgctg tggtgccatc
296251 ttggctcagt gtaacctctg cctcctggtc caagtgattc tcctgcctca
296301 gcccctgag tagctggac tacaggtgtg caccaccatg cctgactaat
296351 tttgtgtttt taatagagtt gtggtttcag tatattggcc aggctggtct
296401 tgaaatcctg acctcaagtg atctggctgc ctcagcctcc caaagtgctg
296451 ggattacaat cgtgagtcac cgcacccagc ctatttaaaa aaaaaaaaac
296501 caagaaactg taaaccattt aaatttagca gtggaggggtt ttataccaac
296551 tttagtgaca ctaaatgtta gtaagttctg ataacccact atcattggac
296601 caaactgtac tataatttt gtcattattt tagagtgtac tgttagaagt
296651 taaccgtaaa acagcctcag gcaggtcctt caggaggtgt ccaaaaagg
296701 gcattgttat cacaggaggt gacagctcca tgcctgttat tgccctgaa
296751 gaccctccag tgggacaaga tgtggagatg gaagacagtg atattgatga
296801 tcctgaccct gtgtaggctg aggctaatgt gtgtgtctat gtcttggttt
296851 tttaacaaaa aactattaaa acgtaaaaac aagaaaaatt taatagaaaa
296901 aagcttataa aataaggata caaagaagac attttgtac agctgtacaa
296951 tatgttgtg ttgtaagtga agtgttatta caaaaaagta aaaagatta
297001 aaaagttta aacatttata aagttaaaaa gttacagtaa gctaaggtta
297051 atttattatt gaagaaaaca actttaatta attagtgtag cttaagcgtg
297101 cagtgcttgt gaagtctgca gtagtgtata gtagtgccct aggccttcac
297151 attcactcac cacttactaa ctcacccaca gcaattcca atcttgcaag
297201 ctccatttat ttatggtaag tactctatac aagcagatct tttaaaaaaac
297251 attttatact atattttac agtatctttt ctatgggcct gtaaggcctg
297301 tgggttctcg cgtcccccag ctccccccgc agccggctcc tcagtggtcc
297351 gctccggttg ccaggtgcgg attctgttcc taactgaagg ctgagtgttc
297401 ttcgccatta actgtggccc cgacaggcct gggttactgc ggccaccgcc
297451 acagcagcct tggcgctatg gaggagcccg gggctacccc tcagccttac
297501 tggggctgg tcctggagga gccacgcagg gttgtggcag cactgcctga
297551 aggcaggaga ccagattcga atccttatgg atttccatgg gaattggtga
297601 tatgtgcagc tgtccttgga tttgttgctg ttcccttttt cttgtggaga
297651 agttttagat cggttaggag tcggctttat gtgggaagag agaaagagct
297701 tgctgtagcg ctttctggac taattgaaga aaaatgtaga ctacttgaaa
297751 aatttagcct tgttcaaaaa gagtatgaag gctatgaagc agagtcacct
297801 ttagaggatg ccagctttga gaaggaggca acagaagcac aaagtttgga
297851 ggcaaactgt gaaaagctga acaggtccaa ttctgaactg gagcatgaaa
297901 tactctgtct agaaaaggag ttaaaagaag ataaatctaa acattctgaa
297951 caagatgagg tgatggcgga tatttccaaa aggatacagt ctctagaaga
298001 tgagtcaaaa tccctaaaat cactgctagc tgaagccaaa atgaccttca
298051 agagatttca aatgaatgaa gaacaaatga agatagcaat acaagatgct
298101 ttgaatgaaa attctcaact tcaggaaagc cagaaacagc ttttgcaaga
298151 agctgaagta tggaaagaac aagtgagtga acttaataaa cagaaaataa
298201 catttgaaga ctccaaagta cacgcagaac aagttctaaa tgataaagaa
298251 aatcacatcg agactctgac tgaacgcttg ctaaagatca aagatcgggc
298301 tgctatgctg gaagaagaca taacagatga tgaaaacttg gaattagaaa
298351 tgaacagtga atcggaagat ggtgcttact tagataatcc tccaaaagga
298401 gctttgaaga aactgattca tactgctaag ttaaatgctt ctttaacaac
298451 cttagaagga gtaagaaacc aaatctatat tcagttatct gaagttgata
298501 aaaccaagga agagcttaga gagcatatta aaaatcttca gacggaacaa
298551 gcatctttgc agtcagaaaa cacatatttt gaaagtgaga atcagaagct
```

```
298601 tcaacagaaa cttaaggtaa tgactgaatt atatcaagaa aatgaaatga
298651 aactctacag gaaattaata gtagaggaaa ataaccggct agagaaagag
298701 aaattttcta aagtagacga aatgatcagc catgccactg aggagctgga
298751 gacctacaga aagcgagcca aatatcttga agaagaactt gagagaacta
298801 ttcattttta tcaagggaag attatatacc atgagaaaaa agcacatgat
298851 aattgtttgg cagcacagac cgctgaaaga aacctcaatg atttaaggaa
298901 agaaaatgct cacaacagac aaaaattaat tgaaacagac tttaaaatta
298951 aatttttaga aaaagatcct tatgcacttg atgttccaaa cacagcattt
299001 ggcagagagc attcctcata tggtccctca ccattgggtc ggccttcatc
299051 tgaaacgaga gctttttctct atcctccaac tttgtcggag ggtccactca
299101 gactctcacc tttccctcca gggggaggag gaagaggccc aagaggccca
299151 gggaatcctc tggaccacca gattaccagt gaaagaggag aatcaagctg
299201 taataggttt actgatcctc acaaggctcc ttctgacact gggcccctgt
299251 cacctccgtg ggaacaggac cgtaggatga tgtttcctcc accaggacaa
299301 tcatatcctg attcagctct tcctccacaa aggcaagaca gattttattc
299351 taattgtgct agacgctctg gaccagcaga actcagaagt tttaatatgc
299401 cttctttgga taaaatggat gggtcagtgc attcagaaat ggaattcagt
299451 ggaaatgata ccaaagataa tcttggtaat ttaaatgtgc ctgattcatc
299501 tctccccgct gaaagtgaag caactggccc tggctttgtt cctccacctc
299551 ttgctccaat cagaggtccg ttgtttccag tggatacgag gggcccgttc
299601 atgagaagag gacctccttt ccctccacct cctccaggaa ccatgtttgg
299651 agcttctcca gattattttc caccaaggga tgtcccaggt ccaccacgtg
299701 ctccatttgc aatgagaaat gtctgtccac tgaggggttt tcctccttac
299751 cttcccccaa gacctggatt ttcccccccct acccgcacat tctgaaggta
299801 gagtgagttc cctttagggt tgagtctgcc ttcaaatgag cctgctgctg
299851 aagatccaga accatggcaa gaaacttgac aatatttttg ctctcttcaa
299901 aagtcatttt gactattctc attttcagtt gaagtaactg ttgttacttc
299951 agtgattaca cttttgctca tattcaaact taatggaatt ataattctca
300001 ggatagtatt ttgtaaataa agatgattta aatatgaatc ttatgagtaa
300051 attatttcca tatcatttta ttctagatag tataactatt ttaatttgtt
300101 taactaatcc actattatat aaacaacagt gggagattta tagatgtaat
300151 cttgcaggtg gggaggcttt acatttgaaa ggccatggca ttatgccaag
300201 aactgtattt actgtggttg tagacaaatg tgaaagtaac tttatgctta
300251 attaaataaa ttttacttga ttaaaaaata tatataggtt gcattattct
300301 tcaggtatgg agagaccaac agatcaagtg tcgattacca ctgaaaaaat
300351 ggtttgttac tcacagatcc caacagaagg gaaagtacta tgccatgcag
300401 cactgaatag ggaggcagta tggtcagcga gaaggcagga gtgatggaaa
300451 aacatgggca agagccttta cagtggcttc catgggaagg aatgagtgag
300501 gcaaggtgag cagggttaag gttagctatt ataatttgag taatttcagc
300551 aggctctggg tataagggct gtccctagtt gtctggtacc tggccctggg
300601 gcgcttaggg cagaggaatg tggcctagag tgtgtgagtc ctgtggaagc
300651 ctgatgaaat aggtgactgg gggcatgagc tctggactgg ttagcttgtg
300701 tgtgaaaagc acgctcatgg gcagattgtt tactgtctct aggaattggc
300751 taaccctggt agggacaggc ctgccaaggt cagcaaggcc ctagatgtcg
300801 aagtgtcaga atacataaaa agacatggtt aatatggtat cagagcctct
300851 gtcttcacat ggcctctcat gaagggctct agaatgagct cccttagggg
300901 atgtcaaagg ccattcaaga cagcagaagc cacaaggcca cgtaaagctt
300951 cagtaatatc taaaagaaga tattaagagt aatatctccc ctagatatta
301001 caaatcatat tatcaaagaa tgtacacccc cgtgatattg gagaaatacc
301051 tcccttagaa attacaaaga atttcatcac aaggtgtacc ctcactgtga
301101 tattaggagt aatatctccc ttatatatta tgaataatat cattacgggg
301151 tgtatacccca ctgtgatatt aggaataata tctcccttag atattatgaa
301201 agggaccaag aaaccttcta tttcattgtt tgctgtgcct agcatccatt
301251 ctgtagatca ctccgttgtt caagtggctg ctgaggctgt agccattacc
301301 ttctcatttt ggtcataaga agatggaagc taggaagaaa gtacacatcc
301351 aacccttttaa agatagttcc tggaaattac acatatcaca tctgctcaca
301401 tcctgtgggc cagaagaaat aaataacata gtatatctag ctgcaagtga
301451 ggctgaaaaa tatcattatt ccctataacc acgtggtcag ctaaaaacaa
```

```
301501 aaaattgcat tactaaagaa gagtaaaaca gaacagatat tgaaagataa
301551 caagcagtct ctgacgcagc atctaagaat aattattcct tttcctgata
301601 tcctgagcac taagatctag ctcaaagttc agccttcact ttgacagcca
301651 ttagagaaag taaatgcact tcataaacta gggaaatgag aattaatgaa
301701 tctcagggtt cccctccgcc ctttttttgg agacggattc tcattctgtc
301751 acccatgctg gagtgcagtg gagctgcgat cttggctcct gaaacctcca
301801 cctctggagt tcaagcgatt ctcctgcctc gacctcctga gtagctagga
301851 ttacaggtgt gtgccaccac acccagctaa tttgtgtatt tttagtaaag
301901 acagggtttc actgtgttgg ccaggctggt ctcgaactcc tgacctcaag
301951 tgatctggcc accttggcct cccaaagtgc tgggattaca ggggattaca
302001 gggggagcca ccacacccgg ccttttttc cctttgtaaa aaccctcttc
302051 attaatacta agagtgttct tgaaagctac agagaaataa atctcccttt
302101 cagtgaattg ataaggccct ggttatttcc tctttacttc acaagatttt
302151 tttttttttt gagaccggat tttgctctgt tgcccagact ggagtgcagt
302201 gggacaatca ttgctcactg cagccttgac atcctggact caagcagtcc
302251 tcctgcctca gcctcccag tagctggaat gacaggcaca gtccacaaca
302301 cctggctaat ttttaatgtt taattttttg ttgttgttat agatacaggg
302351 tctcaccacg ttgtccaggc tagtctcaaa ctcctgggct caagacatcc
302401 tcccacctca gcctcccaaa ctgctgggat tagaggcttg agtcatcatg
302451 cctggcgcac ttcacaagat ttaagacatt gtctcagatt ctcaacatct
302501 cctggacctt ggccacagcc tcctatttgt tttcttgtct ctgctctctc
302551 cctactccaa accattgcct acccttccgc tggagttact aaatctgcct
302601 atgtaaaact ctcctttggt tcctagagga taaaggatta cttccttagc
302651 ctacatatga gaccctccac tgtgggtccc agcctccttt caccctgcc
302701 cctgcctacc gctcactgtt ccctggccag gcctgtgctt gtgcacattg
302751 cttcctctgc ctggaatgtg cgtctcttta ggttgagact atcctgttta
302801 tctctgaaaa actggttcta ttcctccccc atcccaagaa agaacaggta
302851 attgttccct ctgctatgtt cccattacac tttctttgta gagtcacact
302901 gtaatgatct cttcacagat ctcttgtcct gatcactctg taagctcctc
302951 agaggcaaag aacatcatgt cttaccaagt tacctacata ccaagggctg
303001 tctggtgcct gacgcaaaca gaacagaatg aagtagaggc tcagcaaaag
303051 ctagtggtcg gccaggagtg gtggcccatg tctgtaatct cagcactgtg
303101 gaaggtcaag gtgggtggat cacctgaggt caggagttcg agaacagcct
303151 ggtcagcatg gtgaaacccc acgtctacta aaaatacaaa aattagctag
303201 gcgtggtgtt gggtgtatgt aataccagct cctcgggagg ctgaggcagg
303251 agaattgcct gaacccagaa ggtggaggtt gcagtgatcc tagatctcat
303301 cactgcactc cagcctgggt gacaaggtga aattccatct caaaaaaaaa
303351 aaaaaaaaaa aaagctggtg gtcagatcga tggaaacaaa ttcatgaaaa
303401 tgtttccttc aacctgagaa agctgattaa taaaagaaaa acatgtaaaa
303451 taaaataaaa tgtttctgtc tggcaatgat cagaatcata tttgcttttc
303501 ttttcttttc tttttttttt tttttgagt ttctctcttg tcgcccaggc
303551 tgatgtgcaa tggtgcaatc tcggctcact gccacctccg cctcccggag
303601 gcaattctcc tgcctcagcc tcccgagtag ctgggtaggt gctcaccacc
303651 acacctggct aattttttgta gttttagtag agaaggggtt ccaccatgtt
303701 ggctaggctg gtctcaaact cctgacttca ggtgatccac ccccctgggc
303751 ctccaaaaat gctgggatta cagacatgag ccactgcgcc tggtgcatat
303801 ttgctttct taactaggtt gcacttaata cctattatag tcaacagact
303851 gagttgaagt cttaagagac acatcaaaca ttcacttatt cactcagagg
303901 ggccagattt ggtgccagac ctctagtgag gaggccacta gagtaacctg
303951 ggggagaaat gggtggctca gccactagaa ccaactaaga agaccacaat
304001 tattaaaatt ttaattattt atttagaaac agggtcttgc tatgttgcct
304051 gtgctggagt gcggtggcta ttcacaggca tgatcatagc tcactaagcc
304101 tcaaactcct gggttcaagc catcctccag cctcagcctc tcaagtagct
304151 gggaccacag gtgcatgcca ctatgcctgg cttaaaagac cacaacgttt
304201 tagagctatc ttctagtggt acatctgcag ttttaccttt agtaacagtg
304251 ccacattctt cttcattcta gaccactgca ttctgagcca tcagtataaa
304301 catttatttc cctgaatgag atgaagccaa agacctactg ccttaataat
304351 ggacagacag tggaacagag catgaaatag ctgtttgtcc tgaaaagggt
```

```
304401 tttttttttt tttaggaaac agcagagact gtaaagatgc tgaagcctct
304451 gtccctcttc cctggagacc aacaaccttc atttccagtc tcagttcctg
304501 tgctgttcac acggatggtc cagtgatgat ctggttccca tccatccagc
304551 ctatgaatca gggaggaaaa tgaacagtgg tactgattga gggaagcttt
304601 cttgaggttt tctgtttcct tatgaagtat ctggatgaca agcttccctt
304651 caatgcattc tcaggggctt ggtctttacc cagagcagag gctgagaaaa
304701 ttattaagat ttctgaagca gtctgtccca ccctaacaca tcacaaatgc
304751 gagcatttga agaacaagag ccacatgcag ttatttattt atttatttat
304801 ttatttattt atttatttac ttacttatga cagagcctgg ctatgttgcc
304851 caggctagag tgcagtgatg caatcttacc tcatctctgc ctctggggct
304901 caagttatcc tctcacttca gcctccggag tagctggtac tacaggtgca
304951 caccacaatg ctcgactaat ttttttgtaga gacaaggttt ttccctgttg
305001 cccaggctgg actcaaacct ctgggctgaa gcaatcctcc cgccttggcc
305051 tcccagagtc gggggattac aggcttctgc acccagccgc cttctctttt
305101 tgttaataaa ctctttgctg tgcacagctg agagtgggga ctcaataaat
305151 gtcaacagag gattgtgttt ttacagacag atggacgtgg aagaatccag
305201 aaacactggt gttactatgg tttatttagt ttgctggatt ccaacaccaa
305251 atgagagagg tattctattg tagaaaaaca gaaatcctat tggatataaa
305301 tttaatgaaa atctcgagaa ctattcagaa acaaccaaat aaaaccatac
305351 ttaagagtat gtgggctagg tgtggtggct cacacctgta atcccagcat
305401 gttggaggcc gaggcaggtg gatcacctga ggttgggagt tggagaccag
305451 cctgacgaac atggagaaac ctcgtctcta aaaatacaaa attagccggg
305501 cgtggtgacc catacctgta ttcccagcta ctctggaggc tgaggcagga
305551 gaatcacttg aaccctggag gaggaggttg cagtgagcca agattgcaca
305601 ttgcactcca gcctgggtaa caagagcaaa actccatctc aaaaaaaaaa
305651 aaaaaagatt atatgaagtt taaaacttca tacctttaag taagattata
305701 atgttcttat aacatattag ccagctgaag cggctcacac ctatatccca
305751 acactttgga aggctgaggc aggaggatcg cttgagccca ggagttggag
305801 aatagactga gcagcaacat agggagacac acactctata atcttttttt
305851 ttttttttg agatggactt tcactcttgt tgcccaggct ggagtgcaac
305901 ggcgtgatct cggctcaccg caaactccac ccccggattc aagtgattct
305951 ccagcctcac actcacaagt agctgggatt acaggtgccc gccacaatgc
306001 ctggcttttt gtatttttgt atgtttttttt tttttttgag acagagtctg
306051 gctctgtcac ccaagctaga gtgcagtggc atgagcttgg ctcactgcaa
306101 cctccgcctc ctgggttcaa gcgatgcttc tgcctcggcc tcttgagtag
306151 ctgggattac aggcatgcgc caccacaccc agctaacttt ttagtagaga
306201 cggggtttca ccatgttgat caggctggtc ttgaactcct gacctcgaga
306251 tccactcccc tcggcctccc aaagcgctgg aattacaggc gtgggccaat
306301 gcgcccagcc cacattttgt attttttagta gagacagggt ttcaccatgt
306351 tggcccggct ggtctcgaac tcctgacctc aattgatcca ccaccttgg
306401 cctcccaaag ggctgggatt gcaggcgtga gctaacatgt accaactaca
306451 aaattgtttt ttttacttgt taggtgtggt ggtgagcccc tcctgtgcat
306501 acaccctgtg atatattatt cgtaaatatct aaaagatttt actcctaata
306551 tcacagtggg tgtataccag tgatattatt cataatatct aagggagatg
306601 atactactcc taatatcaca gtgggtgtac accctgtgat attattcata
306651 atatctaaaa gaagatatta ctcctattat cactgtgggt gtacactctg
306701 tgatatgatt cataatatct aaaagaagat attgctccta ataccacggt
306751 gagtgtacac actgcgatac tatttgtaat atctaaaaga agatattatt
306801 tgtaatacct agaagaagac attgctttta ataccacggt aggtgtacac
306851 cctgtgatac tatttgtaat atctaaaaga tattatttat aatacctaga
306901 agtagacatt actcctaata tcacagtggg tgtatactct gtgatattat
306951 tcatagtagc taagggagct attactccta atttcacagt ggctgtacac
307001 cctgtgatat ttttataat atacaaggga aatattactc tagcatcaca
307051 gtgggtgtac accctacgat gtaccccta tgatgttcct tttttttttt
307101 ttttttgag actgagtctc actctgtcac ccaggctggt gtgcagtggt
307151 gtgatctcag ctcactgcaa tctccgcctc ccaggttcat gccattctcc
307201 tgcctcagcc tcccgagtag ctgggactac aggtgcctgc caccacgcct
307251 ggctaatttt tttgtatttt tagtagagac agggtttcac cgtgttagct
```

```
307301 aggatggtct caatctccca acttcgtgat ccgcctgcct tggcccccca
307351 aagtgctggg attaaggtgt gagccactgt gcccggccta agtgtgatat
307401 ttcttttaat gtcacagtgg gtggacagtc tgtgatatta ttcgtaatat
307451 ctaagggaga tacaacttct aatgtcacag tgggtgtaca ccctgtgata
307501 ttattcgcaa tatccaaggg agatattact cctaatgtca tagtaggtgt
307551 acacccttta atattttag gaatattcaa gttagatatt attcgtaatg
307601 tcacagtggg tgtacaccct gtgatattat tcataatatc caagggagat
307651 attaggacta atatcacagt ggttgtacac cctgtgatat tttcaaaata
307701 tccaagggag atgttactcc taatatcaca gtgcatttat accctgtgat
307751 cttattctta atatccaaga ttgatattac tcctaatatc acagtgggg
307801 tacacccagt gatattattc ataatatcca aggggatat tactgctaat
307851 atcacagtgg gtgtacaccc tgtgatatta ttgctaatat ctatgggaga
307901 tattactcct tttatcacag tgtgtgtgta taccctgtgt gtacatcctg
307951 tgatattatt cgtaatacct aaaagatatt gctaaaagca ctccttgtgg
308001 tttgcgcatg ttgagatgaa aatgagatgg aggtcatgat cttttaagg
308051 gtggaaaagc atgaacacaa agtatcattt cataaagcca attgcagcat
308101 ctctgtccat ggggcttcag gggaagagat gaaacctttg ttgagattct
308151 accatgtggg tcaggcaggg acacagagtt atttatggga cagcccttgt
308201 cttagttggt gagaggagga aaaaggagca aaaacctgaa aggggatgtg
308251 cagggccagg atgcgagtgg gggtcgcatt ccagtaatag ctaagtctgg
308301 gcaagggga ggaccaggct gtgagatggt ggtggatgga ggggtacaag
308351 gggaatggct ctgaaggatg tattggtaga tgtaaaagaa ggtgtccagg
308401 ggtctggcct tgctggagga cttcggggga tggtagcagc agcataaata
308451 acatagaagc atcaaatagg agactaagac ttcaaaagtc aatcaagaag
308501 tacagagggg aaagtgcaat ttagggctag atcatggaat gaggagatgg
308551 gccaaatgct ggggatgggg ggatatcatt gtagaaaggg ctgagatggc
308601 tttggaggga gttcccctaa cccaaaggtt ctctaaagaa agtgggagtg
308651 atttaaaata cacttgaagg aaactataaa actgcctgag aaataaaaga
308701 agacccaaga tttcaaaaaa tcctgggtca gatgtggtgg ctcacctctg
308751 tatcctagca ctttgggagg ctgaggaggg acgatcgctt gagcccagga
308801 gttcgagacc aacctgggca acagagtaag accctcctc cctgtgaaaa
308851 aatacaaaaa tgtgtctggg cgtggtggca actgcctgtg gtcccagcta
308901 ctcaggaggc tgaagtggga gaatcacctg agcctgggag gttgaggctg
308951 cagtgagctg agattgtgcc actgcactcc agcctgggtg acaaagtgag
309001 aacctgtctc aaaaaagata acagaagatt gggtgcggtg gtgtgtgcct
309051 gtagttccag ctacttggga agagagctga gtgggagaa ttgcttgagc
309101 ccaagagttc atggctgtag tgtgctatga tggtgcctat gaatagccta
309151 ctgcactcca gcctgggcaa catagtgaga cctccatcta tacagaataa
309201 aagataggag aagggtaggc ctagaaatgc cgcatagtgg aacagttaat
309251 aagagtctct gttggaggcc acctgggttt gaatttttat tctgccactt
309301 ctgccatctg aactgggaca gtttctccat ctataaaatg ggggtgattg
309351 ttcccatctt ataaagtcat tgaatatta atgagccaa tgtgtgtgag
309401 gttcttaaaa caacgtctgg catgtagtta atgctcaatt ttatttctt
309451 ttgtggtctc tttgaaatgc agaagcaagt tacagtatta tgcctataac
309501 taacattcag ttatttttcct tcctacattc attagataag tatttgacaa
309551 agtgttgcac agcccccttgt tctaagaaaa agagttcttg gattatgtgt
309601 tgtggtgatg ttgcacgtat acactctctc ttggttagca gactggcttt
309651 tggaagtccc acagtaaata caggtaactg ttgacctcct gagctagtgt
309701 tctataaaac acactttgag gaaacactgt gttgtataaa tctagatcag
309751 agaaaaggtt aaacgacaga tcatctcaaa atctcaaata ggtctctttt
309801 tttttctttt ttaagagtcc tcgtctcact gtcatccagg ctggagtgca
309851 gtggtgtcat gaccacagct cactgcatgc agcctctaac tcctagggtc
309901 aagcgaccct cctgcctcag ccttctgagt agctaggact ataggcatcc
309951 aacatcatgc ccaagtactt ttttgtaaat tttttttttt tgagacacag
310001 tctcgctctg tcgcccaggc tggagtgcag tggcgccatc tcagctcact
310051 gcaagatctg cctcctgggt tcacgccatt ctcctgcctc agcctcctga
310101 gtagctggga ctacaggcgc ccaccaccac gccaggctaa tttttttgta
310151 ttttttagaa gagacggggt ttcaccgtgt tagccaggat ggtcttgatc
```

```
310201 tcctgacctc gtgatccgcc cgcctccgcc tcccaaagtg ttgggattac
310251 aggcctgagc cactgcgccc ggccaatttt ttgtacattt tttaagagat
310301 gggatttcgc tatgttgccc aggctggtct caaactcctg gcctcaagtg
310351 atcctcctgc ctcaatcttc agagttgctg ggattaacag gtgtgagcca
310401 tcatgcctgg ctctattcaa atgggccata tttttatagc cattaaaata
310451 gattcaagta aaacattagt atttggagat tagatgtatt gtttatttca
310501 agacacatct atcaactgaa ttagtagtta ttttgaacaa tcaacattta
310551 atgatgattg cagcaattac tcaaataatt aaagcaaaag tagaattttc
310601 gcaataatta ctgaagcaac tgtgcttgac tagagctgcc ttttgtgggc
310651 tttaagtctt tatggttccc tttttttttt tttttttttt ttctgagaca
310701 gagtcttgct ggagtgcagt ggtgcaatct cggctcactg caacctccac
310751 ctcccggggtt caagcgatgc ccctgcctca gcctccagag caggctggga
310801 ctacaggcgt gcaccaccac gcctgactaa ttttttgtat ttttagtag
310851 aggtgggggtt tcacgatgtt ggccaggatg gtctcaatct cctgaccttg
310901 tgatccaccc aactcggcct cccaaagtac tggaattaca ggcgtgagcc
310951 accacgcccg gctgtaacaa gccttttcta aatatcaatt tagttggaga
311001 aatagtttag gaaaaaattc aagagtgcca actacaaaag atagatgtag
311051 taaacttcat tagtttcaag aattgtgaat attaagagcc ttggtgtggc
311101 cgggcgcggt ggctgacacc tgtaatccca gcgctttggg aggctgaggc
311151 aggtggatcg caaggtcagg agattgagac catcctggct aacatggtga
311201 aaccctgtgt ctactaaaaa tacaaaaatt tagccgggtg tggtggcggg
311251 cgcctgtagt cccagctact cgggaggctg aggcaggaga atggcatgaa
311301 cccgggaggc ggggcttgca gtgagccgag attgtgccac tgcactccag
311351 cctggcgac tgatcaagac tctgtctcaa aaaaaaaaaa aaacaaaaac
311401 aaacaaacaa acaaaaccca gagccttggt gtatgtagtc caatctaatt
311451 acaggaatag aacacaaaca caaaaaaaac aaatgttttc tcactatctg
311501 cccttagggc cacacctcct tgtctccatg taaccaggga tgatggtggg
311551 tgaataatta actgctgttt attggtgcta atgaagaaca gtcacataaa
311601 taatacaggc tcttagactc caggtcagta ttcccatcct ggtcacccca
311651 gtgccaggta ccagacaaat agggacacaa ccactatgtc ccagagcctg
311701 agaaattatt taagcaagtg aatcctaaat tggcttacct tgtcttgcct
311751 gtggaaacca caacaaagac tcgtggccat gctttctcct cgcctctctg
311801 cctcttgatg gatcccagcg cttgctcgtg gcattgcatg gtgtggcatg
311851 ccccagctct tggaaactgt gagttacaaa ctactttttc aagggcagtc
311901 atctcctgat ctgttagctt caccatatgc tatagcttga atgtgatccc
311951 cacagttcat gtgctggaaa cttgatcctt tgtggtagtg ttgggagttg
312001 gagcctaatg ggaggtgttt gggtcatgcg ggcatggccc tcataaacag
312051 attaatgctg ttaccttggg agtggatttg ccccatcttg ctttctcttt
312101 tcccttttcac catgtgatga tgctttccac catgggatga cacagcaaga
312151 aggccctcag caaatgctgg catctttatc ttggacttcc cagcctccag
312201 acatgtgaga tacaaacttc catatattat atattacctc atctgtggta
312251 ttgtgttcta gcagcccaaa atggactaag acatgatacc tgaataagaa
312301 taaaccctac attttaaaa acagcctgtt agaacaattc aagggaccgg
312351 aagtttgcat tatgttgcaa ggcaacagtt tcagcagtga actgatggca
312401 aagttcttta ccatcttaag ctgaaaatgg cttcccggta catttcaata
312451 attctcagcc tccagggcaa tagagaatga atctattcat gttttcaag
312501 caatgaacta tcagatatct gaatacataa cggtctttcc tcagataccct
312551 ttacaagaag cacacacatc aatctatgga tttctttgaa cattttttcc
312601 actcttattc ctataataat tagcattttg caagtcattt tgacttcagt
312651 tacccagtga attgagtgtt ttcttccaac attctcaggt ttttcaaaga
312701 ttatttattc attcattcat agatcaatta agcagaccct cagcagtcac
312751 atagccttca ctggtttatc agtgtctttt tttttttttt tttttttttt
312801 ttgtgagaca gagtttcgct ctgtcagccc agactggagt gtagtggcac
312851 catctcggct cactgcaagc tccgcctcct gggttcacac cattctcctg
312901 cctcagcctc tcgagtagct gggactacag gcacccgccc ccacgcccgg
312951 ctaattttt tgtattttta gtagagatgg ggtttcaccg tgttagccag
313001 gatggtctcg atctcctgac ctcgtgatcc acctgccttg gcctcccaaa
313051 gtgctgggat tacaggcgtg agccaccgtg cccggccatc agtgtctttc
```

```
313101 ttaaaatgtg gtgtatgcca ggctcggaga ctcacacatg taatcccagc
313151 actttgggag gccaaggtgg gtggatcact tgaggccggg agtttgagtc
313201 cagtctggcc aacatggtga aaccccgcct ctactaaaaa tacaaaaaaa
313251 taaaattagc tgggtatggt ggtgcatgcc tgtaatccca gctactccgg
313301 atgctgaggc aggagtattg cttgaacctg ggaggtggtg tttgcagtga
313351 accgagatca aaccactgca ctccagcctg ggagacagag tgagactcca
313401 tctgaaaaaa ataaaaacat taaaacgtgg atttactatt actggcttac
313451 cacacagggc ttcactggca ctattccctt cccgatctag agactgggta
313501 tattctattg cttggcatgc cattgacaaa catgtctggg tccttccttc
313551 taaataaatc accatgaaac agattgtatc ctataactaa gcaattatac
313601 agttgctttt ttttttttt ttgagacgga gttttgctct tgttgcccag
313651 gctggagtcc aatgatgcaa tcttgtctca ccgcaatctc cccctttcag
313701 gttcaagcga ttctcctgcc tcagcctccc gagtagctgg gattacaggc
313751 gtgtgccacc acgcctggct aatttgtat ttttagtaga gacagggttt
313801 ctccatgttg gtcaagctga tctcgaactc ccgacctcag gtgatttgcc
313851 tgtctcggcc tcccaaagtg gctggcttac aggcgtgagc cacagcgcat
313901 ggccactacc gtagcttttt gaattttag ttatggatgt aaaattcacc
313951 atcgttaagt atacaggcct cattacagca tgcttctttc cttttactta
314001 aaaaagttt taaaactcaa gaaccccccaa atttttttt tgtcctgctc
314051 tgttgcctag gctggagtgc aggggtgcca tcatggctta gtgcagtttt
314101 gaccaccagg gttcaagtga ctcttccacc tcagcctccc gagtagctgg
314151 aactacagat gtgttccacc atgcccagct aattaaaaaa cattttttt
314201 tttttttgta gagacagggt gcagcgatgt tgcccaggct ggtcttgaac
314251 tcctgggctc ctgcctcggc ctcccaaagt gctgggttta caggtgtgag
314301 ctaatacatg ttaactgtag aaaaatgatc agataaatat gaaagagcta
314351 gttctctgta ttcttattcc caagatataa tattttggta tacattactt
314401 catacgtttt cctctgcgta aagctctagt ttttttaatg gataaaatta
314451 cacatacaaa tgttttaaca acttgctttt ctcaattatt aatatatatt
314501 ggatagtcta gagccatact taagaatgaa ttacaattat cagcagagtt
314551 ccttgagggc agggactatc ttttttttt ttgaggcaga gtcttggtct
314601 gtcgcccagg ctgttgtgca gtggtgcaat cttggctcac tgcatgactc
314651 actgcaagct ccacctccca ggttcacacc attctcctgc ctcagcctcc
314701 tgagtagctg ggactacagg cacatgccac catgcctggc taaattttt
314751 tttggttttt tttttttgt attttagta gagatgggat ttcactgtgt
314801 tcgccaggat ggtcttgatc ttctgacctc gtgatcctcc cgcctcggcc
314851 tcccaaagtg ctgcgattac aggcgtgagc caccgtgccc agccttaggg
314901 cagggactat cttaagtaca gtcatgtacc acttggtgtt tcagtcaaca
314951 atggactgca tatatgacaa atatcccata agattatagt ggagctgaaa
315001 aattcctgtt gcctagtgat atcagagtca tcatgacatc ttagtgtaac
315051 atgttactca tgtttgtggc gatgctggta taaacaaacc tactgcactg
315101 ccagtcatat aaaagtataa acacacagtt atgtatagta cataatactt
315151 gataatgata gtacataatt atgttactga tttatgtata tactctatta
315201 ttcttttttt aagacggggt cttgctttat cgcccaggct ggaatcaagt
315251 ggcgctatct cggctcactg caaccctgc ctccggttc aagtgattct
315301 tctgcatcag tctcctgagt agctgggatt ataggtgcgt gccaccaggc
315351 ccgactaatt tttgtatttt tagtagagat gtggtttcag catattggcc
315401 agactggtct tgaaatcctg acctcaagtg atgtgcctgc ctcggcctcc
315451 caaagtgctg ggatgacagg cgtgagccac tgcacccagc ctgttttatt
315501 ccaaaaaaaa tttaagccat tcaatttag cagtggggg ttgtatacga
315551 actttagtga cactaaatgt taataagttc tgataaccca ctaccattgg
315601 accaacctgt actataattt tttgtcatta gagtgtactc ctacttacat
315651 atatataaaa agttaattgt aaaacagcat caggcaggtc cttcaggagg
315701 tgtccaaaag agggcgttgt tactataggc ggcgacagct ccatgcctgt
315751 tatcgcccct gaagaccttc cagtgggaca agatgtggag gtggaaggca
315801 gtgatattga tgatcctgac cctttgtagg cctaggctaa tgtgtgtgtt
315851 tatgtcttgg tttttaataa aaagtattta aagagtaaaa ataaaaaaa
315901 ttaaagaag cttataaaat aaggatataa agaaatatt tttgtacagc
315951 tatacaatgt gtttgtgttg taaatgaagc gttaatacaa aagaataaaa
```

```
316001 acgttaaaaa agtttaaact tttttttttt tttttttttt tgagagtgag
316051 tctctctctg ttgccaggct ggagtgcagt ggcgcgatct cagctcactg
316101 caacctctgc cttccaggtt caagcaattc ttctgcctca acctcctgag
316151 tagctgggac tacaggtgcc tgccaccatg ctcggctaat ttttttgtat
316201 ttttagtaga gacggggttt caccatgttg gccaggatgg tctcgatctc
316251 ttgacctcgt gatccgcccg cctcggcctc ccaaagtgct gggactacag
316301 gcgtgagcca ccacacctgg ccccagttta aatgtttata agtaaaaaa
316351 gttagagtaa gctaaggtta atttattatt gaagaaaaaa ttttaattaa
316401 ttagtccagc ttaagtgtgc agtgcttata aagactgtag tagtgtacag
316451 caatgtccta gatcttcaca ttcactcccc acttactcac tgactcaccc
316501 agagcaattt ccagtcttgc aagctccatt tatttatggt aagtactcta
316551 tacaagcata tattttaaaa aatcttttat actatatttt tactgtatct
316601 tttctatgtt tggatacaca aatacttgtg gttgtgtttc agttgtgcac
316651 agcaggccat acagtgacgt gctgcacagg tttgtagacc aggagcaatg
316701 ggttatgcca catagcttag gtgtgtagga ggctgtaggt gtgtaggtgt
316751 gtaccatcta ggtttgtgta agttcactct atgatgttcc tacaatgaag
316801 aaattgccta acgtgcattt ctcggaaact atcctcatca ttaagcaaca
316851 taactgtatt tatgaaacac aacacatagg tgattcaatt gttaaatgac
316901 tgtattataa tgattcctcc gagactacag gtcacacatt tcaaccaata
316951 atgggacaac ttttccttta aatttctgta gaactcttaa gatggatggt
317001 gtgattcatt taaatcactg attacatcta acattattct gtgttcatat
317051 tcactatttta ctttaataat ttggtcccaa atattttaaa agagcaagtt
317101 agaagacagt ctcatatctg acacagtaaa tggaagaata ctagttaatt
317151 gattctacta ttgtttccac tcatccatat gaacagccca gtccgctccc
317201 aacagtgtct ccctgccagg ttgcattaat aatgcaaatt aatataagta
317251 gtagttgatt atattccatt tacgagtact atgcttggtt atgcctgcat
317301 atagaaaaat tccagtttgg attacagatt cttttctcac aactctttca
317351 gtgttattgt attatctaaa ataaattatt gatttaatgt ctcttaccac
317401 gttcaagatt tcacttacat ctccagctat gcttttggtc actatctaga
317451 cttacattaa gtaaacataa agtaaaaaga tgtgagcaaa acaccatgca
317501 tttgtctttg ttaatgattt agaaaagcct taattcaaat tataatttta
317551 taccatttt aacccataat agtttgtaat ccaagttaca acatagccca
317601 gtaattttgc ctgatgagcc aaaggcagtt aaaaaccaaa ttcttttttct
317651 ggttttaat atgtaaactg attgttcata aaattttcat cgtttcacat
317701 atttaaccta tctcccaaag tttaaatcac taaaataaca tggaaaatat
317751 atcattgatt aattttcagt ctgagtatga aaaactaccc tagtatggac
317801 aaatggactt ttgcaataag cagaatcaag acagtgaaca atgcctcgtt
317851 gagccaggaa aaaatgcaag tctttgcatg ttaaaataca agaatgtttt
317901 atgtcctatc tacatttata tttatctatc attatatatt taaggtatgg
317951 gtattatact gtattagtat cattctattg gcttaacaaa aggttttatt
318001 taaaaagttc tcttagtcaa tgtatttttt tttttttttt tttgagacag
318051 agtcttgctc tgtcgtccag gctggagtgc agtggcgcca tcttggctca
318101 ctgcaagctc cgcctcccag gttcacgcca ttcttctgcc tcagcctccc
318151 aagtagctgg gactacaggc gcccgccacc acgcccagct atttttttttg
318201 tatttttta gtagagacgg ggtttcacca tgttagccag atggtctcga
318251 tctcatgacc tcatgatccg cccgcctcgg cctcccaaag tgctgggatt
318301 acaggtgtga gccaccacgc ccggcccaat gtacttttta aaatagactt
318351 tatttatta ttgagatgga gtctcactct gtcacccagg ctggagtgca
318401 gtggcacaat ctcagctcac tgcaatctgt gcctctcggt ttcaagtgat
318451 tctcgtgcct cagcctcccg agcagctggg atacaggtgc ctgccacctc
318501 tcctggctaa ttttgtatt tttagtaga gatggggttt gctatgttg
318551 gccaggctgg tctcaaactc ctgacctcag gtgatccacc cgcctcggcc
318601 tcccaaagtg ttgggattac aggcgtgagc caccacttcc ggtcaactta
318651 gttttttaga acagtttgta tttatagaaa agagaagac agcattgagt
318701 tcccatatat aaactctcct agtttctcct gttaacatct tacgttagta
318751 tggttcattt gttacaattc atgaatgata taatgataca ttattaacta
318801 aagttcatgg tttattcaga tttccttagt tttcacctaa tgttcttctg
318851 ctccagcatc ctatccagtt accacattac acttgtcatg tcctcttaag
```

```
318901 ctcctcctgg gtgtggcagt ttccctgact ttccatgttt tggtgaccct
318951 gaaagttttg agtagcatca ttaagtgttt cataggatgc ccctctgaat
319001 ttgtctgatt tctcatgatt agactaaggt tatgggttgt ggaaggacgg
319051 ccagctcaat gtaattttct taagataaat ttgatatgta tggagataaa
319101 aacacaccta gatttcacca aactgttgtc atggacataa acttcagtat
319151 catttttagt actatgtctc tgttgtataa ttagaggcag aaaagaatat
319201 gatttttcaa aaggttggct taaaaaaaaa tgagaggtag aggccgggca
319251 cagtggctca tgcttgtaat cccagcactc tgggggggccg aggctggcgg
319301 atcacgaagt caagagatcg agaccattct ggccaacatg gtgaaacccc
319351 gtctctacta aaagtgtgaa aattagccag gcgtgttggc gtgcgcctgt
319401 agtcccagct acttgggagg ctgaggcaga agaattgctt gaacccggga
319451 ggtggaggtt gcagtgagct gagattgtgc cattacactc cagcctggtg
319501 atagagcgag actgtctcaa aataaaataa aattaaatta aattttaaaa
319551 gaattttaaa aagaggtaga taacatcata acgatagcaa acagtagtca
319601 ctttaatttg ctttcccaag taagcacatt ctttacaaat taaaattatg
319651 atagaaagcc agacaaaatg cataatacat acatagttaa atttcatata
319701 ccttcagagg tagaatttgg gatttatgta aataaatgtt actcaagtat
319751 atctatgttt tcaaagcata ttgtcacatt tttgtctgca gaataaacaa
319801 taaaaaagga ttttgcagga ttctctgagc ctatgggtca aaaatagccc
319851 atcataaatc cttagaaaat ttacagtagg caaataattc tctactgaat
319901 ggcagttctc aaactgattt ggtgggtctg gtgtgggttc tgagagtgtc
319951 catttttaac aagttccagt gatgctgatg ttgccggtct gagaagcatc
320001 atgagaacca ctttctggct gggtgtggtg gcttacgcct ataattccag
320051 cactttggga ggctgaggga ggtggatcat gaggtcagga gtttgagacc
320101 agcctggaca acatggtgaa accccatctc tactaaaaat acaaaaatta
320151 cacgggcgtg gtggcgggca cctgtagtcc cacctactcg ggaggctgag
320201 gcaagagaat cgcttaaacc tgggaagcag aggttgcagt gagccaagat
320251 cgtgccactg cactctagcc tgggtgacaa ggtgagactc tgtctcaaaa
320301 aaaaaacgag aaaaaaaaaa aagaaagaa aaccactttc cctgatactt
320351 taccatccag gaaactacac ttactaagtg cctatgattt ttattttatt
320401 ttattttaat tttttttgag acagagtctc actctgttgc ctaggctgga
320451 gtgcagtggg gcaatctcgg ctcactgcaa gcgccgtctc ccgggttcaa
320501 gccattctcc tgcctcagcc tccagagtag ctagaactac aggcgcccgc
320551 caccacacct ggctaatttt ttttgtattt ttttagtaga gccagggttt
320601 caccatgtta gccacgatgg tctcgatctc ctgaccttgt gatcctcccg
320651 cctcagcctc ccaaagtgct gggattacag gtgtgagcca ccgcgcctgg
320701 cgcaagtgcc tatgattatt aaggtgttat atatgtatta ccttatttaa
320751 tcatagaatc ttatgtcagt atgattgctc cttttataaa tgggaatctg
320801 agacttggag aggagaaaat aggatgagca gcaaaactac aatttggatc
320851 tcttttctaat tctaacactc atgttttcct gaacaatgta ctgtttctag
320901 ttgataaagg agggaaatgt atgcatcctt gccatgctca tttgaaaaca
320951 gacaacgtat ctaaagatgt atagagtgat tggttcaggt cacagggcgt
321001 taactaaagg acagtgattc ttaagaacca ggcaaagact cagggtcatg
321051 aagaggattc acttatctct gaactgaaat aatcacgggt gatgtgaatt
321101 tagtgtataa ctaacaaaat aggaagaatg tgtttaatat agtatggtat
321151 attccttaat tacaattatt ttattattcc ttacagaaaa catacaaata
321201 aaagtcctta aaagaataac ctcatttaaa tgtaaagcat catactattc
321251 tagatgtctg ccagtgtata ctacattact aatcaaccac tacttactct
321301 gaaattgagg taacacagcc tgaggcaaca aaatgctctg acaattactg
321351 aaacgtttat ctcctttcac aaagcaaatc aaaagcaatg acattacaca
321401 acaaataag caatttaagt tttaagaaaa gcggtacatg atacagaaat
321451 agactgccaa aaatgaaatt gccagtaata taaatttctc tcactttgtt
321501 atattgtata taaaaaggaa cactaagcgg caaaattatc caactgtaga
321551 tgtcaaatat ttaatgaggt ctaaacttca gagtgacaaa aacacccacc
321601 caactctaca tctctatcaa aacaaatata ttatgtaaga aagaattccc
321651 tttaaatata tatgtatata tagtcatgtt atactgttaa ttaaacccat
321701 aattctattt atttaaataa gaattaaata aactgcccaa atgcttattt
321751 tcatttcaca aaacataaag tattttaaat cacaacttca gggtggtata
```

FIG. 7 CONT'D

```
321801 ctgaatacat tggttcctta gacagcatca acaagcatat ttttaagaat
321851 atattttcat ctataggcca ggtaaagttt tattaaatga tgaacatttt
321901 ttaacagtgc agaaatacaa gttttaaaaa caaatacatt cagaagattt
321951 gctgttcaaa taatattttt tcaaaaccag gtggaggcgt atgataaaac
322001 tcactgaact ggcaatccaa aattgcactg tcatcaacta aaggatacaa
322051 aaagaaagaa aataaattag aagcaaatac tttaatttca atgaatacat
322101 aattataaaa taaaataaac tgtctccata atactacaat attaataggt
322151 aagaagaata aatatatctg ctgtccctgt tacaaaacat aatcctatgg
322201 gtaaaaacag ccacaacaaa aatcaaaatc tatctgtcaa aaacattgga
322251 aggatatata taaaaatatt attagtaatt ctctcaagag gatgtgaata
322301 tgggtaattt ttttcttatt tgcttatctg cattttctca attttatata
322351 attaagacat attacttttt aaaaaaatgt ttaactttga aaaagtatag
322401 attcacagga agttgcaaaa atgttaagag tccagtgcac cctttgtaca
322451 ctttgcccca gtggtaacat cttacatgac tacagctcaa catccaaacc
322501 aggaaactga cattggtaca ctactgtgaa ctagactgca ggccttactc
322551 agcttctaaa tgttttttacc ggtatttact caagagaaat gaatgtgtat
322601 atccaaagac atattttcaa acgttcacaa tagctttatt tgtaatagtc
322651 ccacactgga acaaccccta atgtccatca actggtgaag gataaagaaa
322701 ttgtgatata tccacacaat gctacacttc tcagcaataa aaactgatga
322751 attattgata tatgctacag cataaatgaa tcttcaaata attgtgctga
322801 gtgaaagaag ccagaccaaa agaaaagacc atatgatttt gttaatataa
322851 tactctagaa aatatgggct aatctgtagt gacagaaagc agatcagtgg
322901 ttgtttggtt ggggctgggg tagggagtgg tgagtaggat ataagaggca
322951 gaaggaaacc tttggggtgg tgaatatgtt cattaccttg accctggtga
323001 tgacaaaaca aaacatgacc gtaaagcaaa gcaagtaaat aatcagcact
323051 gccacccaat agtgattact cccctgggt gaggaatgca gctgtggtgc
323101 gggctgcatc tgggccaaga aaatgttcta tttcttgatc taagtggtaa
323151 taatgtgagt gttcacttga tagctatttg ttaaattgca catataagtt
323201 taatgcacat tactatatac tttatatttc agcataaatg cagaaaaaaa
323251 tgtaaatact ggatttgaca ttcatgaagt caccagtgat tttaacaagg
323301 gtggtttcaa ttagtggtgt aatggcagct gaattgggtt gcagaacaaa
323351 cgaacaataa caataaaggt gtcaaatgct ctacccttga gctagtcaag
323401 taatctatac aacaaacccc ccaccgtgac accagtttac ctgtgtaaca
323451 aaccttcaca tgtaccccg aacctaaatg ttaaaaaaaa aaaagaaaga
323501 aaaacaataa agatggcaga tataggttat tctagaagaa atgtggccat
323551 ccagggaagg ggaaacacag gactagtgag ggatgcatgc caaagaagg
323601 gcgtttggga tggggcttag aatgttata agcactgaag agggaggccc
323651 atgacatgag atatcgatga aataactgac aaagtgacgt tccagatttg
323701 gggagtttgg aatccagact acagatagag tgtttgcaac atgcagagta
323751 ccacttctgg gatgagatgg aaagaaggca ggattggacc tgaagagagg
323801 gaagctggag ttcacttgtg attgcctgtt ttttttgtaa ggtagaaggc
323851 aaggcattttt cagaggatga atagagaatg caagaagcac agaatgcata
323901 gacatgcaca aagaattgct gaaaattatt gagagctcag attaggctag
323951 aagtcataac tttgtttttt tttgtttttgt tttgttgttt tcttttttga
324001 gacagagtct cgctctgtca cccaggctgg agtgcagtgg catgatctcg
324051 gctcactgca agctccgcct ccccggttca cgctattctc ttgcctcagc
324101 ctcccaagta gctgggacca caggcacccg ccaccacacc cagctaattt
324151 tttgtatttt tagtagagac ggggtttcac cctgttagcc aggatggtct
324201 caatctcctg acctcgtgat ccgcctgcct cagcctccca aagtgctggg
324251 attacaggcg tgagctactg cgcccagcca ggaagtcgta actttgtaac
324301 cacacttctt cagtgttatg cagtcttttt ctttctacag gctgagtgta
324351 agaagagaca aaatgaatga ttggattgat caaggattag ggatggaaga
324401 caaaagagta aagggattta agttttatgt ttatctttga taggatcagg
324451 ctattaaaac acttggttta attggactga tttatgagtt caatttatga
324501 aatataattt agtatctata accttagtac attacaaata atgctgaata
324551 aaagaaacag tttagagcat taaacttatt tgctacagtt aacttgtata
324601 actgtcactc tactgatatt tattttattt ctcaggctaa cctatttcaa
324651 atatcaagct aaatttccat ttactcaagt aaataaagga attgcttta
```

FIG. 7 CONT'D

```
324701 ggcttaccca atatgcaaca ctaaattgag ttttaaaaca cacatttaca
324751 tgcaaggaca cagaaggtaa aatgactgaa aagtaatttt aggagaaaag
324801 aaggctaatg aaaaccttaa actaaaaggt aatcacaagc tttggctatt
324851 atcatattat tatttatatt tgttattgta taattctgac atcccagttt
324901 gtcatcattg atactgctat ttttatttta gtattttaat tttattttgc
324951 ttttgagaca gggtcttact ctggtgccaa ggctggagtg cagcggcacg
325001 atgatcactg ctcacaggag acttgacctc cccggctcaa gagatcctct
325051 cagctcagcc tctcaagtag ctgggactac aggcacgtac aaccacacct
325101 ggataatttt aaaatttttt gtcgagacgt gttctcacta tgttgctcaa
325151 ggctggtctt caactcctgg actcgagcaa ctcttacctc agcctcccaa
325201 agtgctggga ttacaggcat gagtcattgc accagtgctg cttttatagt
325251 aaactacaac aaatgtaatt aaattagttc ttttttttt ttttctttt
325301 tttgagatgg agtcttgctc tgtcacccag gctggagcac agtggtgtga
325351 tctcggctca ctgcaacctc tgcctcctgg gttcaagtga ttctccgcct
325401 caccctcctg agtagttgcg attacaggtg tgtgccacca cacacggttt
325451 caccatgttg gccaggctag tcttgaactc cagacctcaa gtgacccacc
325501 tgtcttggcc tcccaaactg ctgggattac aggcatgagc caccgtgcct
325551 ggcctaatta gttatttttc tttctttttt aatttattt tatttatttt
325601 ttttttgtgg agactaagtc ttgctctgtc gcccaggctg gagtgcaatg
325651 gcatgatctc ggctcactgc aacctccatc tctgggttc aagtgatttt
325701 cctgtctcag cctcccatgt aactgggatt acaggagtgc gctaccacgt
325751 ctggctaatt ttttgtattt ttagtagaga tgggggtttca ccatgttggc
325801 caggctggtc tcaaactcct gacatcaagt gatccaccgg cttcggcctc
325851 ccaaagtgtt gggattatag gtgtgagcca ccacgccagt cctaattagt
325901 tcttattata acccaaattt aagaacttaa atgagaaaat attttagac
325951 ttacaaaacc aaaggcagaa aaatcatata cctgtttact taaagttgat
326001 aatacaaaat aggctggaca cggtggctca tgcctataat ctcagcactt
326051 tgggaggccg aggtgggcag atcacttgag ctcaggagtt cgagatcagc
326101 ctggccaaca tggtgaaacc ccatctctag taaaaatata aaagttggcc
326151 aggtgctcac acctataatc ccagcacttt ggaaggccga ggcgggcaga
326201 acagaaggtc aagagatcaa gaccatcctg gccaacatgg tgaaacccca
326251 tctctactaa aaatacaaaa attagctggg tgtggtggtg cgtgcttgta
326301 gtcccatcta ctcgggaggc tgaggcagga gaatcgcttg aacctgggag
326351 gcggaggttt cagtgagcca agatcgtgcc actgcactcc agtctggcga
326401 tggaatgaga ctctgtctca aaaaaaacaa aacaatacaa aaaaccca
326451 aaagttagct gggtgtggtg atacacacct gtaatcccag ctactctgga
326501 ggctgaggca cgagaatatc ttgaacccag gaggcggagg cagcagtgag
326551 ccaagatcac aacactgcac tccagtctgg gtgacagagt gagactctgt
326601 ctcaaaaaaa aaaaaaaaa aaagttgata gtataaaaa taaagcagaa
326651 tggattgata aagacattgt ggttatgttt ttctaaaaaa aaaaaagaa
326701 agagacctttt ttttcgagat acaaataaaa catttatgaa taaaattata
326751 tattacctgg catttgcctc aaaataaccc aaggagggta agtgaagaac
326801 aatagcagca ttgggggtgg ggggtgtag atgaaacccg attggttaca
326851 agttgataat tgtttgaagc tggctgatgg gtatatgagg gtttattata
326901 ctattctttt tacttctgta catgtttgga atttctata ataaaaatta
326951 aggtaggccg gatgcagtgg ttcatgcctg taatcccaat agtggtgcac
327001 acttgtagtc ccagctactg gggtggctga ggtgggagga ttgcttgaac
327051 ccaggagttt gaggctgcag tgagctgtga tcgggccact gcactccagc
327101 ctgggggaca cagcaagact ctgtcgcaaa acaaaacaaa acaaaacaaa
327151 acaaaacaaa aaacaaaaa attaaagtta aattaaaat tctaagtcac
327201 tatttccctc agaagagcat taacatttaa ggaatttgt aagggttatt
327251 aatgtacagt ctacataaaa ttcccatctc taattccaaa atattattta
327301 taattatgtt tcctggccat gcaatcattc ccaatgactt gcagaaaaag
327351 ttttctaaat tcagtaaagc ttttgaaac ttctaaaac ataaaactac
327401 atgttgaaaa agggagtacg gttattgcat atttaagtgt aatcattgta
327451 tttagcaagt ttatttaat acatggggaa cagaaactat ccttaatcct
327501 gcaaagtggg attgtaatat cctaccgact acaatccata taaaaaggtc
327551 cttatggctg ggcacggtga cttatacctg taatcccagc actttgggag
```

```
327601 gttgaggtgg gtggatcatc tgaggtcagg agtttaagac cagcctggcc
327651 aacatggtga aacccccatct ctactaaaaa tacaaaaagt agccaggcgt
327701 ggtggcaggc acctgtaatc ccagttactc gggaggctga ggcaggagaa
327751 tcgcttgaac ccaggaggcg gaggctgcag tgagctgaga tcgtgtcact
327801 gcactccagc ctgggtgaca gagtgacact ccgtttcaaa caataaataa
327851 ataaataaaa taaaaaggtc cttattaaca atgtgtccag atttctagat
327901 gatagctata aaagtaacat acacgctgat atggtttggc tgtgtcccca
327951 cccaaatctc gtcttgaatt atagttccca ttatccccat gtgttgtgga
328001 gggacccagt gggaggtaat tgaatcatgg gggtggttac actcatgctg
328051 ttcttgtaaa agtgagtgag ttttcacaag atctgatggt ttcataaggg
328101 gctttcccca acttcgctca atcttctcct tcctattgcc atgtgaagaa
328151 ggatgtgttt gcttcccctt ccgccatgat tgtaagtttc ctgaggcctc
328201 cccagctctg tggaactgtg agtcaattaa acctctttcc tttataaatt
328251 accaagtctt gggtatgtct ttatagcagc atgaaaacag actgatacac
328301 acaccaaaca agttaatatg tatgtaataa tacattagaa atatttttgc
328351 ttaccataaa caactggata cactgtccct cgtatacctg atgctggaca
328401 atgcatgttt tttccattca agtatacatt taattcgaca tggtcataag
328451 taatacccta ggaaggaaaa aacagaaacg ttccataaaa gctgagccgt
328501 cagaaagcat tgactgggaa gtatggaaac acaaaaagct aagcataggc
328551 tgacaacaat tttcattaag ggttgacaat ttggtagaat cctacttgaa
328601 ctgagctaaa aaaatgagta gtgattatga gggggataa agtcaggtaa
328651 catcccaaga gtccacatta gaggtaaaac aaagccaaca gtttaaatcc
328701 tagaattata tttgtataat ctggattta tattttgaat gctaagataa
328751 tataagtact acataccatg aatagagaaa ccttttacac tcatacagaa
328801 aacgctgctc tttctctaca gaatttgatc taaagaagga aaaacaatga
328851 ggttttttc actgtcagga cttactacct gtcactgttt tcaaattatg
328901 aagaaacgtc tctatacatt ttatttccag gaagaaataa cacatttcta
328951 catctcttta ctctggtttc aaatgtgtca agtgtattat caaggaaaag
329001 ctggtgttca caactgaata aaattggtaa ttagtttcaa gttaaaaaac
329051 aaaaatagta gctcaaatga tttaaaaaac aatgtaataa aattactcgg
329101 tacactattg atggaaaaaa atcacaatta gtgatattaa taattattgt
329151 taaaataatt attttataat tatataaata aatattttat ttgtataaat
329201 ataaattatt tatataaata aataaaaggc tagaaaagac ttagcccatg
329251 ttataaacca atagtgctac tattctaggc agttcatatt tactcattta
329301 atcctcacaa caagacagta ttactatccc cattttacag atgaagctaa
329351 agcacagaaa gattaagtaa tttacctaag gttgcacagc taggaagtgg
329401 aaaagctgtg atttaaatcc atacagtatg gtttcagaat ccttgctctt
329451 aatcacaata cctctctcta aatcaccatg cctctcttta aacacttgct
329501 cttaatcacc atatctctct ttaaaacttt atacaatagc tactaactga
329551 taacaaaaag agatctttcc cttgaaagac agcagagatc tttcaataga
329601 gaagtcatca tagaccaaga agcaaaccac ttcaaggatt tcaggatttc
329651 tgactgtgga tacattctat caagttaaaa gcttttaga ggtaaaaaaa
329701 aaaaatttta tagatcatct tagtcttaaa ttctctctct ttacaagcaa
329751 gacagcaaaa gcccagagaa gctaatgtgg taagtggtat gaaagattct
329801 caattcttag caaagccagg gttaacttaa acaattatta ataattaagg
329851 aatactgaga aagataaata gtacatagat tgcctttgct tcgctttagt
329901 ttatgtcttt agataatagt aataaagcta gctgatggct gggattcact
329951 tttctaatga aaagtctgt tttcatttta aaaacaaaa acttaattac
330001 ataaaaaga aagtatgtta ctctcattat gggactacca gaaatctagc
330051 agttcagatc agtgaggttg taatccaggc actttcatcc cccagtggcc
330101 gattgcaaac aaacaagttt gttttttgtt ttttttttga gacagagtct
330151 cgttctgtca cccaggctgt agtgcaatgg catgatcttg gctcactgca
330201 acctccactt cccaggttca ggagattctc ctgccttagc ctccccagta
330251 gctgggatta caggcgcccg ccaccatgcc tggctaattt ttgcattttt
330301 agtagagatg gggtttcacc atgttggcca ggctggtctt gaactcctga
330351 cctcaaatga tctgcccgcc tcggtctccc aaaatgcgga gattacaggc
330401 gttggccacc gcgcccagcc tcaaacaagc aagttttaaa cccaagcctg
330451 cagtagcaaa atcccagtac caaagaagtg aggaaagatg tgagaagtcc
```

```
330501  caccctcagt  atagtttagt  tcaagtattt  tctttctttt  tttttttgag
330551  actgggtctc  actctgtcgc  ccaggctgga  gcgcagtggc  gcgaccttgg
330601  ctcagtgtga  tacgcccgcc  tcagcctccc  gaagtgcagg  gattacaggc
330651  atgtgccact  gtgatgggcc  agttcaagtg  ttttctaacc  taatctattc
330701  tatgatgaag  aaactgggtt  tgattctgcc  aaaatgatag  caaaatatac
330751  tgtgtgttct  atgtctttat  taataattgt  gtgcaggtta  gtgaacagat
330801  tctgaaatta  gactgcttca  ggtatgatct  tggttttttgt  ttttgttttt
330851  gagacaaggt  cttttttttt  tttttgagg  cagagtttcg  ttcttgtcgc
330901  ctaggctgga  gtgcaatggc  gcaatctcgg  ctcactgcaa  cctccgcctc
330951  ccaggttcaa  gtgattctcc  tgcctcagcc  tcccgagtag  ctgggattac
331001  aggcatgcac  cactacgcct  ggctaatttt  ttgtattttt  tttagtagag
331051  acggggtttc  tccatgttgg  tcaggctggt  ctcgaactcc  tgacctcagg
331101  tgatctgccc  acctcggcct  cccaaagtgc  tgggattaca  ggcgtgagcc
331151  accgcacccg  gccagagaca  aggtcttgct  ctgtgtggcc  caggttgggt
331201  ggagtgcagc  ggcaggatca  cggctcactg  ccgcctttat  ctcccaggct
331251  gaagcagttc  tcccacctca  gccttccaag  tagctagaac  tacaggggca
331301  tgccactatg  cccggctaat  tttcttttta  aatttttatt  atttatttat
331351  ttgtttgttt  gtttgtagag  atggggtctc  actatgtttc  ccaggctggt
331401  ctcaaattcc  tgagctcaag  ggatccttct  gccttggcct  ctcaaagtgc
331451  taggattaca  ggcatgagcc  atagtatctg  ctgagctat  atagtcttgt
331501  aattaactca  cataagaagt  tacttaattt  ctcttaatct  gtaaaatggg
331551  gataataata  ctactaccgt  acgggcgtgg  tggctcacac  ctgtaatctc
331601  agcactttgg  gaggccgagg  tgggtagatc  acttgaggtc  aggagttcca
331651  gaccagcctg  gccaaaatgg  tgaaaccctg  tctctactaa  aaacacaaaa
331701  aaattagctg  ggaatggtgg  caggcacctg  taattgtagc  tactcaggag
331751  gctgaggcag  gagaaccgct  tgaacccggg  aggtgaaggt  tgcagtaagc
331801  cgagactgca  tcattgcact  tcagcctggg  caacaagagc  aaaactccat
331851  ctcaaaaaaa  aaaataaat  aaataataat  aataataata  ataataataa
331901  taatacctat  ttcaagggc  cattatgagc  attaaacaat  ttaatccttg
331951  ccaggcactt  agagcagtgc  cataataaaa  tgcttaggtc  tgggcacggt
332001  ggctcatgcc  tgtaatccca  tcactttggg  aggccaaggt  gggtggatca
332051  cgaggtcagg  agttcgagac  cagcctgtcc  aatatggtga  accccgtctc
332101  tactaaaaaa  atacaaaaat  tagccaggcg  tggtggcacg  cacttgtagt
332151  cccagctact  agagaggctg  agacgggaga  tcgcttgaa  tccaggaggt
332201  ggaggttgca  gtgagccgag  atggcaccac  tgcaatccag  cctgggcaac
332251  agagtgagac  tccatctcaa  taaataaatg  cttagaagtg  tttgttattg
332301  ttattattac  atagaatgtt  tataagactt  ctctaaaagt  aaactgatac
332351  atgcatgtta  gaatgaaatt  tgtacttttc  agaattatat  gtataaggag
332401  aaagtaggcc  gggcacggtg  gctcacgcct  gtaatcccag  cactttggga
332451  ggccgaggtg  ggcagatcat  gaggtcagga  gttggagacc  atcctggcta
332501  acacagtgaa  aacccgtctc  tagtaaaaaa  tgaaaaaat  tagccagtcg
332551  tggtggcggg  cgcctgtagt  cccagctact  caggaggctg  aggcaggagt
332601  atggcgtgaa  cccaggaggt  gtagcttgca  gtgagccaag  atagcgccac
332651  tgcactccag  cctgggtgac  agagcgagtg  ccatctgaa  aacaaaaaaa
332701  aaaaaagga  gaaagtgagc  ataaactgtt  tcatgtatgt  ctttctagtt
332751  ctgtagcagg  ccgtgctgta  ctgggtgatt  atcatatgaa  tataatcata
332801  taatcatttg  gttagatgtt  cacagcttat  ttttcttgat  ttctcctcag
332851  agaatggtac  atgacttaaa  ttctaaacac  atgagaatgc  ttttcctgtc
332901  ttataatcca  ttctacttat  tgcatgccac  tgttaacaat  ttggtaaaat
332951  ttgttctcca  gtgtttgaac  tagttaaaat  agcagggtaa  tgttttcttt
333001  ttcttggctc  tgcatgtatt  tcatagtttt  agttctcctt  ttatgagaat
333051  gagctcatat  gaaaactcga  agtctaattt  aacaacactg  acagactaaa
333101  agtggcattc  ttcagtctgt  cacactgtgc  tatcagacat  tacaatgaac
333151  gaaatgagat  aggaaggcag  gtagaagttt  cagttcatca  acaaagaaaa
333201  acatttgtta  ctgattatcc  tttcttatgt  ttgaatttca  tcttttaggg
333251  taaacaggtt  gacagcatca  acttgacttc  aagattctct  ttcagaaaat
333301  taccatttga  ataaggatgt  tccatattat  gggcatctgg  caatgatcta
333351  caaatacaga  accaactatt  caaaaagcat  gggaaaaagc  agattttttt
```

FIG. 7 CONT'D

```
333401 aatggcttat gcctttcatc tccttttttt ctttagtcaa ttctggaaaa
333451 aaaacttcca acaattaaaa acttacagtt gttcatattt tttaaattgc
333501 aaaaaagaga agaaagatca ggccgtaatt aaaaatctta atttccacac
333551 ctttcttcat tctttctaaa atactgtacc ttttcataat taattaacct
333601 ggatttctct tatctttcca tcttattaga atccttctct cattattcat
333651 agattccttt caacttgata tcagaattga gaacccaagg ttcagtgtac
333701 aagggcacct cggctgaagg agactctagg actctgttct aaatcaatgg
333751 cctgacctct ggatagggag gggttttgga taatgcagtg tggaaggaag
333801 tatctggaaa agacagaaag aaatctttgg attacatttt caatgtgcta
333851 gctttgtaaa gagttaaata tagccagtta ggagtaaaaa cagaaaagtc
333901 ttaataacgt gtaacttta ctatcctctg ctttctaaaa aaaaaacttt
333951 tctacgatca agctttagga ttttgagttc cgttctctga agagtttaat
334001 taggttaagt ttaatgaaga tgaacatttc tgataaaatg ctgtaattct
334051 cttaatagaa tttcataaca aattaagaaa tacatgtgtg gctaggcgcg
334101 gtggctcatg cctgtaatcc cagcactttg ggaggccgag gcaggtggat
334151 cacttgaggt caggagttcg agatcagcct ggccaacatg gcgaaacccc
334201 gtctctacta aaaataaaaa aaatcagcca ggcctggtgg tgtgcgcctg
334251 taatcctagc tactcgggag gctgaggccg gagaatagct tgaacctggg
334301 aggcagaggt tgcagtgagc caagatcatg ccactgcact acagcctagg
334351 tgacagagcg agactctaag aaaaaaaaa aaaacaagaa gagaaataa
334401 atgtgaacat tttccctaag agatatccag ccttaaaaat aactagtatt
334451 ttctaatata agcttcagca aacttttaga attgtgggcc aagttttctc
334501 taatgtgaga gaaacaggaa tgtgtgatca gcagacagcc tgtcattaat
334551 tctccagagt agaaataagg gttcacactg attttcccag ccagtggcag
334601 ctctaaaaag gaggggggcag ttgagtaggg tgcaacatct acaccaagtg
334651 ctctcctgga aaatgcacca tctcattaga tccaatccca ctgctttgga
334701 attcaaacca caaactccca gacaaagctg tagatactaa aagcagttca
334751 aatttagtca tttacagtgg aaagcaactc catgagggaa ctcaccacca
334801 catctccttc ctgcggaaga ctgtttgctg gcagcctatt tttctcttca
334851 ttgttgtggt aaagggctcc atcatttctc atcaccagac tgtgcatatc
334901 tcggccaaga ggaatctgat tcaagttaac cttctgagtt gcaacaccaa
334951 taccccagat tcctaaaaat ataacagttt aaatgccctc aaaatctgaa
335001 gactacaacc atcgagttat tttaaaaggg agtataaact ttttaaagga
335051 agtgctgtat taacactaaa ttgtttcta ttactctttt taaaaaatct
335101 tcttttagaa gtagtttgca ccagcctggg caacatgccc aaaccccgtc
335151 tctacaaaaa atacaaaaat tagttgggca tgggagcatg tgcctgtaac
335201 cccagctact caggaggctg aggtgggagg attgttggag ccagggaagt
335251 tgaggttgca gtgatccatg atcattccac tgcactccag cctgagcgac
335301 aaagccagac cctgtctcaa taaataaaat aaaataaaag tagtttgcaa
335351 actatactat gttctccaca gatgtagtac agcctaggag ataagagagt
335401 gggccctgga acagtgcaaa tgaggattaa atcttgactc tgctacatca
335451 tcttgcgcaa attacctaac ctctctttgt tcccttatct gtgaactgag
335501 gattctaaca gtactcacct tgcaaggtaa tgaaaagata caacaagata
335551 atccaagtaa agcacttgaa cagtgtaagt actccacagc atgagaaagt
335601 aaagcacaca gtaagtattc agaaaatgct agctgtcatc atcatcatta
335651 ttattatctc aaaaagattt tttaaaagct acacattgaa tttaaatggc
335701 ctggagttca atttcaagct ctcccttttga aaagtgggaa tgtactgtct
335751 tcagttttta catctacaat gagtgacaaa caatatatac cataagcaat
335801 atcatggaga ggagaaatta acaataaggt gtaaaatcat ttcttaccc
335851 agtattttaa gccaccacac ccagctaatt tttcttttct ttgtagagat
335901 ggggttgtgc tatgtttgcc caggctggtc tcaaactcct ggccttgagc
335951 aaccctcctg cctcagtctc ccaaagcgct ggaattacag gtgtaagcca
336001 ccatgcccca ttgaaaatca ttatttaaaa ctaatttaga gctaggcacg
336051 gtggcttgag cctgtagttt cagctactgg gaaggctgcg gcaggagtac
336101 tgcttcagcc tagaagctca aggctgcact gagctataat catgccactg
336151 cactccagcc tgggtgacag agcaagaccc catctataaa taaataaata
336201 agtaaaaata atttagaaaa taagccctag ggggaaattt tatatcattc
336251 aaggctggcc aagtaatagt aagattcatt tactccactc tcatttccct
```

FIG. 7 CONT'D

```
336301 attctctacc cacattactg atgcagtatt tcactagaag tttatttaca
336351 ataaagcttg ttttgttttt gtttttgtat ttgtttttt gagacagagt
336401 cttgtactgt tgcccaggct ggagcgcagt ggcacgatct cggctcactg
336451 taacctcttc ttcctgggtt caagcgattc tcctgcctca gcctcccgag
336501 tagctgggat tacaggcgcc caccaccacg cctgactaat ttttgtact
336551 tttagtagaa acggggtttc actatgttga ccaggctggt ctcaaatgcc
336601 tgacctcgtg atccacccc tcggcctccc aaagtgctgg gttacaggcg
336651 tgagccacca cgcccagcca cttttttttt ttttgagacg gagtctcact
336701 ctgttgccca ggctgcagtg cagtggcata atctcagctc actgcagcct
336751 ctgtcttccg ggttcaggca attctcctgc cttagcctcc cgagtaactg
336801 ggactacagg tgccaccac gatgcctgga tgattttgt atctttagta
336851 gagatgggt ttcgccatgt tggccaggct ggtcttgaac tcctgacctc
336901 aggtgatctg cccacctcgg cctcccaaag tgtgggatt acaggtgtga
336951 gccactatgc ccgatcactt tacagtaaag cttttatttt aaaagttttc
337001 ccatatacaa tacaggcaca gttaactaac ctattataat cacatagaat
337051 tgctttacag ttcaagaaac tccataaatt ttaaaaagag aaatatagac
337101 tgcagacttc tatctgaatt ctgaatttga tgactgcttc aaaacactga
337151 atcagggtat cttaataact gagttaagag aaaaactctg gctcatgcct
337201 gtaatcccaa cactttggga ggccgacgag ggcagatcac aagatcagga
337251 gtttgagatc agcctgacca acatggtgaa acctctgtct ctactgaaaa
337301 tataaaaatt agctgggcat ggtggtgcat gcctgtaatc ccagctactc
337351 aagaggctga ggcaagagaa ttgcttgaac ccggggaggcg gaggttgccg
337401 tgagtcaaga ccgcgccact gcactccagc ctgggtgaca gagcaagact
337451 ccatctcaaa aagaaaaaa aaaagaaaa actcagaatc aacagattga
337501 ctttaatcct aaaataaata gcaagagtat atgctgctta tatgtttgac
337551 cttatatgct tgaccaaaca agagggttca tccggatccc attaaaaata
337601 ctagtgcctt atatttatgc agcatgtctt gtcttaaaac actttcatac
337651 atagagttcc tgtgaggcag aatgggcagc tcctgtaata cccatttat
337701 agatgagaaa actgaaccta atttaactaa attaactaat ttacccagga
337751 tcacacaaca agaggtggaa gacccagatc ttctaagagt ttggtgcttt
337801 tatattacct tctgaatctt ttttatgtgt tacaaattac tcttaatatt
337851 tagaacaatt aggactttta atagtaaagt accattatac caacctgtgg
337901 actggatttt gaattcaaaa tagcttttgt tttgatgtaa aggtgcgctg
337951 gctaaacaac ctcctgttcc acatattctt cttccattct ttacaataac
338001 aacatctgtt cctaaacaaa aaatgcagac actatgtaaa gttttgtatt
338051 ttcttttctt ttctttttctt ttttgagacg gagtcttgct ctgtcaccca
338101 ggctggagtg cagtggcacg gtcttggctc actgcaacct ctgcctcctg
338151 ggttcaagtg attctcctgc ctcagcctcc cgagtagctg ggactacagg
338201 tgtgcaccac cacacctggc taaattttta tatttttagt agagatgggg
338251 gtttcaccat attggtcagg ctggtcttga attcctgacc tcgtgatccg
338301 cccaccttgg cctcccaaag ttctgggatt acaggcgtga agcaccgcgc
338351 ctggccaagt tttctatttt caatccaaca atcaggatta atttgttcag
338401 ttctaactca gtccacaaaa aatagggaca ctgtaagtac tttgaaatat
338451 agctgaatta ttttaaatat ttaattcact attttttcct aagagaacat
338501 ttataagtaa tattcatttg tatgtataag ttttaattaa gcatgctggg
338551 tacagtggtt cgtacctgta atcccagcac tttgggaggc cgaggtgggc
338601 agactgcttg agtgcaggaa gtcgagacca gcctgggcaa ccttgcaaaa
338651 ccccatctct ataaaaaata caaaaattag ctggtgtggt ggcacaagcc
338701 tgtagtccca gctacttggg aggcgaggt gggaggatca cttgagcctg
338751 ggaggcagag gttgcagtga actgagattg caccactgca ctctagcctg
338801 ggcgagagaa gtaagtttta attaagcagt ttcaagtaaa ctgcaataac
338851 tctgaattat attgaacgtt caaaacactt ttaaggtaga aatagactaa
338901 ctctttaat ttttagccag gaaccaatt tgatgatttc ataaatttct
338951 taatttaaac caaacataa acacaagaga ctttagtaaa ttggtagttt
339001 tcaattctat tcaaatgaat taaaacaatt tactaaaagc cacctgaatg
339051 cctactaaat acaagctact atacttgtgc attagtcatg taagaactga
339101 agagtacagg gaatatgaaa aagaacacac atctatgttg aaatacctga
339151 cagtgacaaa ctgctaactt taggatctta aaatgtttat taagatagct
```

FIG. 7 CONT'D

```
339201  acttcaatca cattgcaaat atgtaaacaa ggttttaaca ttcttacatg
339251  cactttattc tcgtagaaaa ttttttagat gaaacgacat ctatagatga
339301  gagtgagaaa gagagacact gtctcctgat gtgatcctag taccaatttg
339351  atttaggaaa atgtctatca gagaatatac ataattctaa catgtaagaa
339401  tacacagaat tacataattc taatatgtaa gaaatagccc atacaccaat
339451  gcataactcc ccatacttgt ggccactacc accactttgc tggcaataac
339501  tgtaccagcc aagcagatct gaatattcga actgtatggg actcttccag
339551  aaggggttaa ataaaattag gtcatagtaa caaaaggttg aattaacagt
339601  taaacaaaat tatttggtac aaatacataa aagaaatgca aaattttcag
339651  attctaacac aattctaaac tggttaagag atgctctccc ttaaacaagg
339701  caaaactgag atcctattgt atgattacta aaaattcatt aacatctttt
339751  ttttctaat taaaaaagtt aaccccaaa ttctgggaaa gtacctttat
339801  aaataatttg catctggcta ctccatatac ctccagtaat ttcaactgga
339851  gagcatcctc cttgatggca aagaccatgc agtgcttggc attgagcagc
339901  tgctcatcaa ataactgata aaggttgaat taatatgctg tgctaagcac
339951  tttgtagtgg acatgcagta tctgttctcc ctctcccgac agacttccct
340001  ctggagatca aaacagttcc aagaaagctg actcaatctc tgcttcaggt
340051  gtacaacatt tgatctaggt taaggcaatc agtgccctcc acatttcttg
340101  gccacagtaa ctgagtcaag aactgctaca tgacctaatc aactacaatc
340151  agaatctcag gacttttgca gagcacaatg ggatataaca ctcttggcca
340201  ggcgaggtgg ctaacacctg taatcccagc tctttgggag gctgaggcag
340251  gcagattact tgaggtcagg agttcaagac cagcctggcc aacatggtga
340301  aaccccatc tctactaaaa atacaaaaat tagccaggca tggtggtggg
340351  cgcctatagt cccagctact caggaggctg agacaggaga attaattgaa
340401  cccaggaggc ggaggttgca gtgagctgag atcaggccac tgcactccag
340451  cctgggcgac agagcgagat tccctctcaa aaaaaaaaa aagaaaaaaa
340501  aagaaagaaa gaatattcag ggtgtttatg agtcattagg gaatcatttt
340551  aagcttatcc catttctctt aagtacacag acggttttag aatctgtact
340601  tttaatgatt ggtgctgctt agacggtcaa ggcaaatttg agtacagcca
340651  gaatgccaca taaacatagc cacagaggat gttttaagaa acataaattt
340701  ccaaatgagc ggtgtcccct tcaaagtagc tgccttggaa gtcatttgtt
340751  tctaaaatgt cgattcacaa ttaaaagcca aagatatggc atcaatgata
340801  atacttacaa aaattatgcc atagaaaatt ccaaagagg aattccaaag
340851  tggttttaag taatacaaca tcactaaaat aagtgacaac cctcggagaa
340901  tcacttgaag tatacagaca attttgttaa aaaaaaaaa gcaatcacat
340951  tttttaggtt atttaatata ataatctttc acaccaccaa atccatgtgt
341001  ttctattttc aagtcaagat caattcatgc tgaaacatg ttccttctaac
341051  tcaacaaccc ttttctttca ttttattcag gttctcaaat caggctcctc
341101  tgtgattgaa taatttaagt ttatagaaag acaggctaag aaaaaacttc
341151  ctggccgggc gtggtggctc acccctataa tcccagcact tgggaggct
341201  gagaggcagg cagatcacga ggtcagttcg agaccagcct gaccaacatg
341251  gtgaaactct gtctctacta aaaatacaaa aattagccgg gcttgatggt
341301  gggcgcctgt aatcccagct actcaagagg ctgaggcaga gaattgctt
341351  gaacccggga ggcggaggtt gcagtgagtg gagattgtgc cacagcactc
341401  cagcctgggc aacaatagtg aaactccgtc tcaaaaaaaa aaaaaaaaaa
341451  aaaagaaaag aagaagaaaa aacttccatg cagttagaaa atttggagat
341501  gacattactc tatttcatcc agttagtagc tgacagttgc tggacagctt
341551  tggagaaata aaacacagtg gaatgagtat atctgaccag ctcttcctag
341601  aggaaacaga tgacagagaa aaggaatgct ccaaagagga gactgcagta
341651  attcaagagt ctaacagtaa agataggaag aagtgctgca gttgatcatg
341701  agttccagga attatgtatg gttgtccttc actatattct cagcacttat
341751  aacaatgcct gccacctgat aattgcttaa taaatatcac ttcagtaaat
341801  gagtaactga aatggaaata ttttctgagg aaaactatag aatttgaact
341851  ccatcgtcta taaataatga tggataaaaa ataatttaaa gattacttat
341901  gtattaaggt tctgtactac atttgggaga tctgagaatt aaaagtaaat
341951  acacacatac aaggtgatta tatagttatc acatttagta tgtgttatac
342001  aaaaatacag tgggcagagt gtttccagaa ttataaggaa actgggcgag
342051  agagttttat cataaatatt aagaagtgcc tttttatttc aatgcactgt
```

```
342101 cctttaaaca atcagaaacg tgtaaaaaat caaaagtgca gaagtacagt
342151 tagaataaaa taatccacaa aaagacagta ctctaactga aataattata
342201 ttgggaaatc tctccttcta gaaccacatt ccagaagcat gaaactacct
342251 gggaaaagtc taagaaataa taaggtggtg aaagaggcta tgatgggaga
342301 ggaagaatgt tagataaatt atatggattt ggaattaaaa ggataaagca
342351 agatgcaaag gagcaaagtg ctattttatt tttcaacagt tagacctgtt
342401 gggaagaggc cagtcagatg aaattacagt acctctcaca atgactaagg
342451 agtcgggcaa tgggaggttt tagttgaaat ggcaagttct gacctgaggt
342501 gcgacttcag acttctgcag tctgccttgt ttcgacttta ggaggtgaga
342551 ggaaaattac ttccaataat ataggattca acctataaat gatgggctc
342601 aagagacagg accgacagtc agggcaggag gaggagcaag accggaccta
342651 gaagcattct gaaaatgtgt aggttttcac tggggcgcgc cagaagggca
342701 ctctccgccc cctcgcccga ggacgtgtga catctccgga ggaagcctcc
342751 gagattcctg tgaaaatggg aggtccacac gcccattcgc gatgacagac
342801 acagagaggg ctgcgcagcc ttgaacacag aaccgggccc aggtggagtc
342851 cgccggcttc tggagagatc tgcgagacga aatggtgtcg gcgcagcgtc
342901 gccggcgcgc agcgtgggga ccctctgacc ctgaaggtcc cctgccccgc
342951 ggccccgtg agccgttggg tctgggaag ggagggccct tacccatgtg
343001 ctgcgtgtcc agctgcacgg ccggcatctc cttcagaggg atgtggccag
343051 tcccccgtc tctgcagcac cgcaggcagc acaacaccga ggtggccatc
343101 gcgcagggac caccgactcc gccgccgtcc ctagaccgag gcgacactgc
343151 ccccgccgc tcagctccgt ctcctgcccc cgcccgaggt ccggacttgt
343201 ctatgtggag ctcggaggcc ggtacagcga caccctaggc cgggagggcg
343251 caatgcaggc tgagcttagg ctggcctgcg aggaagacgc ggagaatcaa
343301 ggggccgggg agagaccgga cagggcgagc ggccgggctg ggccggggag
343351 acgggtgggg ctagtggcgc gcggaggcgt ggcaggggc gtggcgttgc
343401 gggcctgcgg atgtgggacg gcgtgcgcct gcgcaccagc tggtttttc
343451 tccttgggcg gtttcgcgca cgcccccagg gctgacaggt gagtggggct
343501 gtctgtccct cagtacttcc aggggttttc ctatgcagaa tttttaaaac
343551 gcagcacccc ttggtcccgg cctcgacatt atttctaggg atggattgac
343601 agaagcgaat cagtttgggg gaaggggagc taatggaaat gacttccgag
343651 ttttccctcc gcgggcccag gttgagcagg ctttgccacc acggagagcc
343701 ccagtctccc tgccgtggct ggtttccctc acatgctaaa tagactcacg
343751 tgggccccag gagtaatgcc tgttagtgac tgcactgtgg atgttcaccg
343801 gggctcacgc gggccctaat gcattttcgg tgcagagacg cgccctacct
343851 ggcccatcgg gctgcgtggt ccggggcgcg tgggaggccg ccctgggagc
343901 agaacgctgg ggcggggtcg ggggcgattc ttgacctgcc tcttccaagc
343951 tcccccctgtc tggtgcactg agggttccga ggaatgtgac gggaacccag
344001 gaggctgcgg gaagtctgct gggtcccgag ggaagccttc ggctcctacc
344051 gtccgctact ttctgcttcc acacgggagg ctgtcacctg tcatctcctt
344101 ccccacttag atcatccttc cgtggtagat tttacatctt caggccgggt
344151 gcagtggctc acgcctgtaa tcccagcact tgggaggct gaggtgggcg
344201 gatcacctga ggtcaggagt tcaagaccag gatggccaac atggtgaaac
344251 cccgtctcta ctaaaaatac aaaaattagc tgggtgcggt ggtgcacgcc
344301 tgtaatccca gccactcagg aggttgtggc acgagaatcg cttaaacccg
344351 ggaggcggag gttacagtga gccagatcg cgccactgcc ctccagcctg
344401 ggcaacagag actctgtctc aaaaaaaaaa aaaaaaaaaa aaagatacc
344451 gcttggcatc tggaaatgtc tgggacgacc tctagaatta acctagctca
344501 aacctctgtt cccagatcag tttcatcctg aaggcttccc tagggatgga
344551 tcatcaagtc ctggaaaact ggacataaaa tgcccactac ttaaataatg
344601 atttcccata cgtaactttt agtgacccga gttataaatg tttttaagg
344651 aggatttcta tctatgcaat gaggggaatt tttcaggttc ctggttctct
344701 ttctataaat ggtgttttca ttacaatact aagggaaagt tttgtacgtt
344751 gaaattaagt taccatagaa tttaataacc aaggtgatta ttaaactgat
344801 tgagggttgg tcttttcccc cattgcgtat gcagtacttt cttggtaatc
344851 atttcacaca agaaatttc ttttatgaca aaccttcatc gttatgctgg
344901 gaattaagtg ctttgatttt tttttttttt tttttttta accccaggga
344951 agtgctgggg gcgggcaggg gggtgagaat tttaacagaa tattggagag
```

FIG. 7 CONT'D

```
345001 acaaaatttt tctaccgttc atatatatat atctagttga attatttcaa
345051 gatttcaagg tcagtattgt ccccatttta taggtgaaga aataggccta
345101 gaggtactaa actttacaac ttcaggtgag caggagataa acaggtagga
345151 ttcaaggctt accagtctga ttcctgttag aagaaaaact tcagctgaac
345201 taaatttaaa ggagttaaac tgagcagtga atgactgggc agcccccaga
345251 atcacagcag attcagagag actccaggga tgcctcgtgg tcagaacaaa
345301 tttttagaca aaaagaggga agtgacgtac agaaatcagc agtgagatac
345351 agaaacagct gcattggtta caggggggcg tttgccttat ttgaacacag
345401 tttgaacaat cagcagtgta tgactggttg aagtatggcc gctgggattg
345451 gccaagactc agctattgtt acaggtgcat actcctaaat taggttttca
345501 agcttgtctg cctattaacc taggttacag ttcgtacaca aggactcaaa
345551 tacagaagta cagagtcctt ctcaggccat atttagtttg ctttaacact
345601 gcctctcaaa ttctttctct tataattaat gctataatcc tcttaaacat
345651 gctctcagtt caaaatgcag atttgccctt ttttgtgtgt ttcatttatc
345701 tccacattgg atataagctg ccataatgca tgtatagaca aaatataata
345751 gaattagttg ttataaagta aaaatttgt tcagaaatat tattaaaaga
345801 agtacatgta ttatatatgt aataaacatt taggccattc aagtcagtca
345851 catcttcaat gaaaagccag acactaaatg gccgtgaatt ggacattact
345901 atagagaggc agaagggcca tagtctttcc tagctggaaa agtaatttgc
345951 tggggcgctg cccggtgcac tttgccccca tcctagcaac tcgagtgtgc
346001 tcagcagaat gaagttagca aaactggtta gctcctgaaa cagacttccc
346051 tgtcttggca gattaacacc atccatgagc tcacttttcc ttctaatatc
346101 tgggattcta atatccattc attattactt tcaaaggaat tatcctctct
346151 ttttgaaaag cacaacgtta aagatgtttt gacactcttt cacagctatc
346201 gctttaaata acaatcacaa ataaagccaa aaatagtttc tcaaggtcat
346251 ttatctaagt cataagcaat aagaaagaat gactacttca aaaaaagagt
346301 ctgtctgctt ccaagacatg ccaggaactc gagaactgag aacaataatg
346351 taaagcttgt gtttcagagt tgagattagc attatgctta agattttctt
346401 taatgttttt tatgccagct ggacgtcttc tgttagtgaa tttcccattc
346451 tgtactgggt catacgaaat gagttttaa aaactcatta atcagttatt
346501 aaacaaaaca ttttccctta gactaatcca aaccacattt gtgatctttt
346551 taaaaatcag aaacattaac aaaaactcat ttttctaaaa actgacatat
346601 ttctggagcc ttgaccaatt cattattata attttgagta actaatagtg
346651 attgacattt atgtagtgct tattattgcc aggcactgtt ctaagtgttt
346701 tttaaaaata aactaattta gtctttgtaa caaccatgtg agggaaaaac
346751 tatcctccac tttacagatg aggaagctga agaaaaaata agaaatgtac
346801 tcaaaagttg cacagtcaat gaaggatgaa gctaaattca aacagacatt
346851 ctggctctag ggtctgtgtt cttaaccact ctgcaaactg cctcctaggg
346901 tgttacattt aaaaatacat tcctaggtct ggtgcggtgg ttcacgcctg
346951 taatcccagc actttgggag gccgagggat atggactgcc tgagctcagg
347001 agttcgaaac cagcctgggc aacatggtga acccctgtct ctactaaaaa
347051 caaacaaaaa aattagccgg gcatggcagt gtgtgcctgt aatcccagct
347101 acttgggagg ctgaggcagg agaatcgctt gaacccagag gcggaggttg
347151 cagtgaacca agatcgtgcc attgcactcc agcctgggtg acagagcaag
347201 actctatctc aaaaaaaaaa taaaaaaata aaaatgaat atacattcct
347251 aatttgtatt tgtctccttc tatcccctttt cctcagagac tgacatttaa
347301 atttacttgg catgaattgt gctcatttaa tctggatttc ctgaattata
347351 agttatatta cctagattga acaaccaaaa ataaataagg aaaataacgt
347401 caaccttgta actgcaacag actgccatta gttggttctc ttagcggtgc
347451 ctttgaatat taatattttg caggtttgtc cttaacaggc tgtctctacc
347501 ggaaaaaaaa aacgatattt agtactttt ttcttctttt tctttttttg
347551 agacagggtc tcactctgtt gcccagactg gagtgcagtg gcaccaccac
347601 gcctggctaa ttttttgtgt ttttttataga gatgggtttt caccatgttg
347651 cccaggctgg tcttgaactc ctaggctcaa gggatccact caccttggcc
347701 tcccgaagcg ctgggattat aggcatgagc caccctgcct ggcctgttta
347751 gtactttttt tttttttttg agacagagtc ttactcttgt cgcccaggct
347801 ggagtgcaat ggtgcgatct cagttcactg cagcctctgt ctcctgggat
347851 caatcgattc ttctgcctca gcctcctgag tagctgggat taccgacgcc
```

```
347901 cgccaccaca accagctaat ttttgtattt ttagtagaaa cgcactttgg
347951 gaggctgagg agggcgaatc acctgaagtc aggagtttga gaccagcctg
348001 gtcaacatag tacttttaat tgctaagaca ggtaaaccag gttggagact
348051 tggaaaatgc agagacttgg cattaggaag aaaaagaagc tggggtaaaa
348101 taaaggaatt tgaaaaaggt acaaaagaaa taaaaataga acaattttt
348151 taatatttaa aatgaagaaa aagcaatagc aagtgctaca taaaaaaggt
348201 ctcagagaat agaaaatgtg atttaccaaa aactttcaac ctagaactgt
348251 accttattct gcttaccttc catggaaaat aaagcagact gtcataaacc
348301 aagggggattt ctgtgatccc tgcccaacct caagttccct tactcgaaat
348351 gcaagtaccc tagtgtattt ctaagtactt ttccttgcca atttagattc
348401 taagtactac tgtggcaata attagcgaaa atagatactg aggatacaaa
348451 agggagacaa agcaaaggtc aaaaccaaag tagttttttg cattttcaaa
348501 agaaataaag gaagatgagg acaagtaaag ttcgtccttg gatctatgct
348551 ccttattaac aggagggcat ttaaacctgt gactttgtag aaagggctga
348601 tgagaagtgt gtacaaagtt ttcatggcca aagataaggc tacataatct
348651 ggtattatgg gagaaaggct ggagaacact tagctgtgcc aaatagttca
348701 aataaaagct tcccaaagca tctcaagcat tcaagtgatt ctgtgtcttt
348751 gaagtacagt aggggtcaag gagcaagaag tcaccatctc cagattataa
348801 agtgaaaaag tactcgacat ttgcagaaag gaccagacag aagaaaaaaa
348851 cacttctggg tatatataat atctgcaacc aaacaaaatt ataaatattt
348901 tgttgaaatt gtgagaaaga ccctaaaata tttctagtaa caaggaaggt
348951 cacatggatt attaaaatgt acccaacatt actaatttag gatagataca
349001 atgccattta gtctctataa ttttattttt gtgaatgtaa aatatttat
349051 aaagtttttc aaaaggctcc acctatagtg acaatccctt caaacctatt
349101 ttctcaataa tggccctgca gatgaatatc cccgggactg tcagaaacct
349151 gcctttgtgt ttgagaagga actgctatac ttctgttaaa gcaagtgtgt
349201 ctatggttgt agatatggtg ctggatagaa ttagtgtagt tctggggaca
349251 actgctaagc cactatgctt tacagattct gtaacctgag tcataggggaa
349301 cgtgggacta cttaaaattg ttggtgaaag tttatgaaac tctggattgt
349351 tcgaaaaatg ctcaaaacaa aaaacaacaa aaaaagaaa caaccctatg
349401 agagttgggt atgatagtac atgtgtgtag tcccaggtac ttggaaggct
349451 gaggtgggag aatcacttga gcccaagggt tcaaagctgt agtgagctat
349501 gatggcacct gtgaatagcc actgcactcc agcctaggca gtgtggcaag
349551 accccatttg taaaacaaga acaaaaacgt gaaataactt tgaaatacca
349601 agagttagtg agaagaagct ccagggatat gtttatggcc aagagaactt
349651 tagtgtagca gaatagattt gcagagaatt tagtataatt aaaatacttt
349701 tttcttattt ttagctattc caaacttta accaaatcct ttttttttga
349751 gacagagtct cactctgtcg cccaggttgg agtgcagtgg cgcgattcgg
349801 ctcactacaa gctccgcctc ccgggttcac gccattctcc tgcctcagcc
349851 tcccgagtag ctgggactat aggcgcccgc caccatttt ttttctatt
349901 tttttttcta ttttttagtag acacggggtt tcaccgtgtt agccaggatg
349951 atctcgatct cctgacctcg tgatccgccc gcctcagcct cccaaagtgc
350001 tgggattaca ggcgtgagcc accgcgcccg gcccaaatgc tttaagaatt
350051 attttacatc ccttcttaag taggtaaact tcctgtttgt agatatcatg
350101 tcttacatct aatgcagata tcagtccaca tcaaacattt aatacattct
350151 taaaaaaaat atgtgaagcc ttggaaagga agagagaagt taggaagata
350201 ctttaatctt tccaatttct taggaaaaaa aggaaaattc cattttatat
350251 gttcttaatt caatgatgtc tgctatgtag tgagcactct gtaaatattt
350301 ataaaaacaa caaatgaacg aagcccccca aataagtaaa tatgtttttt
350351 tgtttgtttt tgttttttga gacggagtct tgctctgttg ccaggctaga
350401 gtgcagtggc ccaatatcgg cttgctgcaa cctccgcctc ccaggttcaa
350451 gtgattctcc catctcagcc tcttgagtag ctgagactac aggtgcatgc
350501 caccacgacc agctaatttt tgtattttta gtagagacgg ggtttcacca
350551 tgttggccag gatggtctcg atctcttgac ctcgtgatcc acccgccttg
350601 gcctcccaaa gtgctgggat tacaggcgtg agccaacaca cccggtcaag
350651 taaatacatt ctaattacac ctcatttcat ccacaaccca gaaagtagta
350701 tgtaaactga attcttagaa aaacatttcc acgttaaatg cactagggca
350751 ggttgccgta taaggaatt ctataaacaa ttttttttt aagagatagg
```

FIG. 7 CONT'D

```
350801 gtctcacttt gtcacccagg ctggagtgca gtggtacagt cataactcac
350851 tgcaactttg aactcctgga ctcaagctgt catcctgcct cagcctccca
350901 agtagctggg actaaggtgc ctgccaccac gcctggctaa ttttttaaat
350951 ttttgtaga gatgggggg tctcattttg ttgcctaggc tggtctttaa
351001 ctcctggcct caagtgatcc tcctgcctca gcctcccaaa gtgctggaat
351051 tacaggcatg agccaccgtg cccagccaca gatttttaa aataacagt
351101 tttattgaga tataattcac atatcataga attcaacctt ttaaagtata
351151 tgtttaatgg ttatagaatg aaccattggt ttatagaata tcactgagtt
351201 gtacaattgc catcgcccca aaataaact taatattact agcagctact
351251 ttccattcct ccctactcca gcccctgaaa accactaagt tactttctga
351301 ctctgtgggt ttacctattc tgaacatttc ataattgg aattgtacag
351351 tatttggtct ttttcattat ctaacttctt tcacttaata tgacgttttc
351401 agggttcatc catgttatag tatctattcc ttcctaatac tttattcctt
351451 tttatggtta aataatattc taccatatgg ataccata ttttgtttat
351501 ccatatattt attgatggac atttgggttg ttgctatttg gcaattatga
351551 gtaatgctgc aaggttttg agtgaacata tgttttaaat tctcttcatt
351601 gtatatctag aagcaaaatt gctggatcga ataatgactc tattgtttga
351651 agaactgaca aacttttca aagtggctgc gccatttac aatcccacta
351701 gcaatgtaca agagttctaa tttctctaca ttcttgtcag cacttgttat
351751 cgtctgtctt ttttatttta gccatcctgg taggtatgaa gtgttatttc
351801 attgtctttt tgatttgcat ttccctattg acacacagtg ctgagcatgt
351851 tttcctgtgc ttagtggcga tttgtatatc ttttttggag caatacctat
351901 tcagatcctt tgtccatttt taaattggga tatttttgtt tttgttgttc
351951 ttgagttgta agagtcttga tatattctag ataaagcca cttatcagat
352001 aaatgatttg caaatatttt ctcccattcc atgaggtgtt tttttacttt
352051 cttgcctttg aagcacaaac attaatttg acagagattt atttatctgt
352101 ttttttttg tcacctgtgc ttttggtact tgtgatggtt agttttatgt
352151 gccaacttga ctgggttaag ggatgcccca tagctggtaa acattatttc
352201 tgggtatttc tgtgagagtg tttaaatgaa agatcagcat ttaaatcagt
352251 tgactgagcc aggcatggtg gctcacacct gtaatctcag cactttggga
352301 ggctgaggca ggtggatcac ttgaggccag gagttcaaga ccagcctggc
352351 caacatggcg agaccctgtc tctattaaaa ataccaaaaa aaaaaaaat
352401 agctggatgt ggtggtggat gcctgtaatc ccagcacttt gggaggctga
352451 ggcaggtgga tcacttgagg ccaggagttc aagaccagcc tggccaacat
352501 ggcgagaccc tgtctctact aaaaatacaa aaaatttgc tggacatggt
352551 ggtgcatgcc tgtaatccca gctactcggg aggctgaggc aggagaatta
352601 cttgaacctg ggaggtggag tttgcagtga ggtgagatca ctccactgcc
352651 ctccagcctg ggtgacatag tgagactctg tcaaaaaaa aaaaaatcag
352701 taaactgaga agttgatgt gccctcaccc atatgagtag gcattattca
352751 atacattgag ggctcaaata gaacaaaaag gtgagagaag agcaaattcc
352801 ttttccccct tctggtatgc catcatcttc cctcagccat cagtgctcct
352851 gacttgggcc tttgaccttg gagacttaca ccagcatgct cccctcctc
352901 agggctcagg ccttagggct tggattagaa gccacaccag tgactcccct
352951 ggttctcggg ttttcagact ggaactgaat tacaccacca gctttcctag
353001 gtctccagat tgcacacagc atattgtggg acttctcagt cttcataatt
353051 gagtgagcca attcccatag taaatctcct cttatatgtc tgtatgtatt
353101 ttattggttt ttttctttgg agaaccctga ctaatcagtg ttatatctaa
353151 gaaaccatta tttaatccaa gattagaaag atttactcct ctgttttctt
353201 ctaggagtta catgcttta gttcttacag ttaagtcttt ggtacatttt
353251 gagttaattt ttgcatatgg tgtgaaggag ttcaacttca ttcttttgca
353301 catagatatc caatcatctc tgcaccagtt gttgaaagga ctattctttc
353351 ccctgttcga ttgttttgcc accttgttg aaattatac aagacttttt
353401 ataacttgaa ttaacaaaga ttttgactac aaagaataat cattcttagt
353451 ttaatctttg taaatagga tagtcagaaa tcataccaag attttgaaaa
353501 tacctgtatg gatgatttat ggttggaaat accactgtga gttttctat
353551 tgactattca tttatagtt acttttgtaa aagccagtag taaagccagc
353601 caggtgcggt ggctcacgcc tgtaatccta gcactttggg aggccgaggc
353651 aggtagatca cgaggtcagg agatcgagac catcctggcc aatatagtga
```

```
353701 aaccccatct ctactaaata tacaaaaaat tagccgggtg tggtggcaca
353751 cgcctgtagt cccagctact tgggagactg aggcaggaga atggtgtgaa
353801 cccaggaggc agaggttgca gtgagccgag atggtgccac tgcactccag
353851 cctgggtgac agagcgagac tccgtctcaa aaaaaaaaag aaaaaaattg
353901 ttttatgacc tcaagatctt tggttttttt ttttttttag tattttattt
353951 gttttaagga ttcctacaga gttagctaac atggtccatg ttcatttcaa
354001 atgtataaat cacccacttc agtattttaa gtttataaaa atctttaaat
354051 gtgtaaatca aaaataaaat tctaagaccc cttcttcccc cagctgtctg
354101 aatggactcc ctcttctcag ccagagcact ccaaagttag cctgaaaaac
354151 tggttcaggc catgatggga agaggggat cagacatgca tcattatgcc
354201 cttctccttt ttggaattca ggaaaagctg accagcatta acatcgacac
354251 agaccttaag tctgataaga aacatttaca atctattctg aaacctgcta
354301 cctggaggct tcatctgcat gataaaactt tggtctccac aacctcttat
354351 gtaacccaga cagttctttc tattcatagt aactcttgca accaattgcc
354401 aatcagaaaa ttttttttcta catgatctac atgtaactgg accccccacc
354451 cttggagttg tcctgccttt ctggaccgaa ccagtgtata tcttaaatgt
354501 atttgattga tgtctcatgt ctccctaaaa tatataaaac caagctgtgc
354551 cctgatcact tgggcacgta tcatcaggac ctcctgaggc tgtgtgatgg
354601 gtgcgtcctt aacttggcaa ttttgagacg gagtctcgct ctgttccca
354651 gactggagtg caatggcatg atctcggctc actgcaacct ctgcctcctg
354701 ggttcaagcg attctcctgc ctcagcctcc tgagtagctg ggactacagg
354751 catgcaccac cacacctgac caatttttgt attttttagta gagacggggt
354801 tttgccatgt tggccaggtt ggtctccaac tcctgacctc aagtgatctg
354851 cccaccttgg cctcccaaag tcctgggatt acaggtgtaa gttgccatgc
354901 ctggcctgca aaataaactt tctaaatga cagagtccta gccagagcaa
354951 tcagacaaga gaaagaaata aagggcatcc aaattggtaa agaggaagtc
355001 aaactatcac tgtttgctga tgatcgtatg cctagaaaac cctaaagact
355051 catccaaaga gctccttcag caaagtttca ggatacaaaa ttaatgtaca
355101 caaatcagta gctatacacc aacagcgacc aagctgagaa tcaaatcaag
355151 aactcaaccc cttttataat agctgcaaaa aaatcacata cctaagaata
355201 tacttaacca aagaggtgaa agacctctac aaggaaaact acaaaacact
355251 gctgaaagaa atcatggatg acacaaacaa atggaaacac atcccatgct
355301 catggatgtg tggaatattg ggaaatgac catagtgcca aaagcaatct
355351 acaaattcaa tgcaattccc attaatacca ccatccttct tcacagaact
355401 agaaaaaaca atcctaaaat ttgtatggaa ccaaaaaaga gcctgcatag
355451 gcaaagcaag actaagcaaa agaacaaat ctggaggcat cacattacct
355501 gatttcaaac tatactataa ggccatagtc accaaaaaca gcatggtact
355551 ggtataaaaa caggcacata ggccaggtgt gatggctcac acctgtaatc
355601 ccagcacttt ggaggccga ggtgggcaga tcacctaggt caggagttcg
355651 agaacagtct ggccaacatg gagaaacccc atctctacta aaaatataaa
355701 aaattagcca ggcatggtgg cacgtgccta taatctcagc tactcaggag
355751 gctgagacag gagaattgct tgaacccagc aggcggtggt tgcagtaagc
355801 caagatcaca ccattgcact ccagccgggg caacagagca agactccgtc
355851 tgaaaaaaaa aaaacaggc acatagacca atggaacaga atagagaacc
355901 cagaaacaaa gccaaatatt tatagccaac tgacctttgg caaagcaaac
355951 aaaaacataa agtggggaaa ggacaccgta ttgaacaaat gatgctggga
356001 taattggcaa gccacatgta gaagaatgaa actagatcct catctctcac
356051 cttatacaaa agtcaactca agatagatga aagacttaaa tctaagacct
356101 gaaaccataa aaattctaga agagaatatc agaaaaaccc ttgtagacat
356151 tgacttaggc aaagacttca tgaccaagaa cccaaaagca aatgcaacaa
356201 aaacaaagat aaatagatgg aacttaatta aactaaaaag cttctgtaga
356251 acaaaaataa ttagaagaat aaatggacaa cccacagaat gggagataat
356301 tttcacaatc tatacatcca acaaaggact aatatccaga atctacaagg
356351 aactcaaaca aatcagcaag aaaataaaca aacagtccca tcaaaagat
356401 ggatgtggtg aaagggaac actttcacac tgttggtggg aatgtaaact
356451 agtacagcca ctgtggaaaa cagtgtggag attccttaca gaactaaaag
356501 tggatctacc atttgatcca gcaattccac tactaggcat ctacccagag
356551 gaaaagaagt cattacaaga aaagacact tgcacatgcc tgtttatagc
```

FIG. 7 CONT'D

```
356601 agcacaattc acaattgcaa aaatatggaa ccagcccaaa tgcccatcga
356651 tcaacaactg gataaagaaa atgtatatat atgcaccata gaatactact
356701 cggccataaa aaggaatgaa ataatggcat ttatagcaac ctggatggaa
356751 ttggagacca ttattctaag tgaaataact caggactgga aaaccaaaca
356801 ttgtatgttt tcactcatag gtgggagcta agctatgaga atgcaaagac
356851 ataaaaaatg ataaaatgga cttcagggac tcaggggaaa gggtgggaga
356901 ggggtgaggg ataaaaggct acacattggg tacagtgtac aatgctcagg
356951 tgatgggtga aatttaaaaa tcttgaagaa aaggttattt taaaataatg
357001 taaatttgct aattaattcc atgataatat ccttcacttt aatgagatta
357051 ttctcatttt ctggcactta caaaagagct cattcaactt ttcaatatat
357101 tgaaaagata tgtcatataa ttttacaata ttttaacttc agtgtttaat
357151 ttttcattga accaaaaaat tctacaataa tgtcaaatag tgaacaaagt
357201 cttaaaataa cttcctttga caagcttaga gaagccaaat ttcaaattat
357251 ttttcattat cattgcacag ttttgaaatc tattatctat tgctcataga
357301 tttttttttt tcttatttta aaaattgggg taaggccggg tgcggtggct
357351 catgcctgta atcccagcac tttgggaggc cgaggcgggt agatcaccag
357401 gtcagattga gaccatcctg accaacatgg tgtaaccctg tctctactaa
357451 aatataaaaa ataagctggg agtagttgca ggcatctgga atcccagcta
357501 ctcaggaggc tgaggcaggg gaatcacttg aaccagggag gtggagattg
357551 cagtgagcca agatcgtgcc actgcactcc agcctggcaa cagagtaaga
357601 ctctgtctta aaaaaaaaat cggggtaaaa aatataatta ttcacacctg
357651 ttaggcagaa taatgacccc caaagatctc cacatcttaa accacagaac
357701 ctgtgaatat atggcaaaag ggactttgca gaaatgatta agtcaaggat
357751 cttgagatgg agagattatc tcagattatt cctggtgagc ccaatataat
357801 caatcacaag ggtccttata agagggaggt aggatgatca gatatgtaat
357851 gatggaagca ggggttggag tgttgtggaa caaggaatgt ggacagcctc
357901 tagaacaagc ttgtccaacc tgtggcccac agactgcatg tggcccagga
357951 tggctttgaa tgtggcccaa cacaaatttg caaatttgta aactttccta
358001 aaacattatg agattttttt tttttttttt tgagatggag tttcactctt
358051 gttgcccagg atggagtgca atggtgtgat cttggctcac tgcagcctct
358101 gcctcccagg ttcaaacgat tctcctgcct cagcctccca agtagctggg
358151 agtacaggca tgagccatca cgcctggcta attttgtatt tttagtagag
358201 atggggtttc accattttga ccaggctggt ctcgaacttc tgacctcagg
358251 tgatccaccc atcttggctg ggcgtgatgg ctcattcctg taatcccaac
358301 actttgggag gccaaggtgg gtggatcact ggggttagg agttccagac
358351 cagaccgggc aacattgtga aaccccgtct ctactaaaaa tacaaaaatc
358401 agctgggcat ggtggtgcat gcctatagtc ccagctactt gggaggctga
358451 ttcaggagaa tcgcttgaac ctgggaggtg gaggctgcag tgagctgaga
358501 ttgcgccact gcactccagc ctggtcgaca gagtgagact ccatctcaaa
358551 aagaaagtaa aggaataaag aatggctacc ccttagactg cagccctgag
358601 ggctgctggc tgcccatttt tatagttatt tcttgattat atgttaaaca
358651 aggggtggat tattcatgcc tccccttttt agaccatata ggataacttc
358701 cggatgttgc catggcattt gtaaactgtc atggcactgg tgggagtgta
358751 gcagtgagga cgaccaaagg tcactcttgt tgccaccttg gtgttggtag
358801 gttttagctg gcttctttac tgcaacctgt tttatcagca aggcctttat
358851 gacctgtatc ttgtgccgac cttctatctc atcctgtgac ttagaatgcc
358901 tgtctggaaa tgtagtccag taggtttcag cctcatttac ccagccccta
358951 ttcaagacgg agttgctctg gttcaaatgc ctttgacaca gcctctcaga
359001 cccaccttag acttctaaac tctagaacta taatatgaga aaactgtgtt
359051 gtttttgtt ttgttttac atttacgggt ttattataaa ggatattaca
359101 aaaatacac atgaagagat aggtagggca aggtatgcgg gaagggggtgc
359151 ggagcttcta tggatgcacc tccctggatg caccaccctc cagaaacctc
359201 cagctatcca gaaactcact gaaccttgtc ctcttgggtt gtaatggaag
359251 cttcatgaca tcagcattcc ttcccccagg gtataggggtg gtactctctc
359301 atgagaaggt cttaagatct ataatcagac aggttgggga acattagagt
359351 ggaaggaggg tgggaggtca gaggcctgcc cctgagtctt aacccaccat
359401 atatgtgtgt gtgtgtgtgt atatatatac acacacacac acacacacat
359451 atataaatat atatatatat atatatattt tgagatggag tcccactctg
```

FIG. 7 CONT'D

```
359501 ttgcccaagc tggagtgcag tggcacaatc ttggctcact gcaacctcca
359551 cccccagggt tcaagcaatt ctcctgcctc agcctcccaa gtaactggga
359601 ttataagtgc gtgccaccat gcccagctaa ctttgtattt ttagtacaga
359651 tggggtttat ccatgttggc caggctggtc tcgaactctt gacctcaagt
359701 gatccacctg cctcggcctc ccaaagtgct gggattacag gtgtgatcca
359751 ccgtgcccag ccctaaccca cccaatattc taacaaaaaa ctgtaacaag
359801 cactatggga gttggagcca ggaactgtgg acaaaaacca atatatagcg
359851 taacaccaca cgccatcctc tggttttcaa ccatggatcc tttacataaa
359901 atatatgttt tattaatgat tatgtataca tacatacaca atcattaata
359951 atcaatccag cccattatac tgttcgaatg attcccagga tgaggccact
360001 cgggtttaca ggtttcctct caatcttgtc aggttccaaa agcagaagtg
360051 gcctcggtaa atacacagct tcaccttttc aggcatctgg aataattgag
360101 ctacgagaaa atgtcatctc ttgccctgag actcttttga cttgttaatg
360151 tgatattgaa ttttcctcaa ttaataactc atttatttat ttgagagagg
360201 ttctggctct gtcacatagg ctggagtgca gtggcatgat ctctgcttac
360251 tgcagcttca acctcccagg ctcaagtgat cctcccacct cagcctcctg
360301 agtagctggg accacaggta tgcactacca tgcctggcta cttttgttt
360351 ttgtttttt ttcctgtaga gataaggtct cccagtgttg cccagctgg
360401 tcttaaactc ctgggctcaa gcagtcctcc tgccttgatg tcccaaggtt
360451 tcgggattag aggcatgagc caatgtgccc agctttattt atttatttac
360501 tctcagctat tattttcct tctgtccatt aatacccaaa ccttttcacc
360551 tttggaaggg acattagaat caccactatg ctggtctaga ttgcaggtag
360601 caatacaagt ctagcaagta tctcctcctc aatacaggtc tagcaagtat
360651 ctcactccca ttcacatagg gtaaggttac acaggtacag aactagtgag
360701 ctcttttcaa caccaggcaa tatagctgca ttcactctta gccccaattt
360751 tgctagatgg ggtgaaggca caatccaccc ccatctgccc ttagaaattt
360801 tgacatagct ttaaaaacat aggctttttt gcctagaact cacccttgct
360851 gttctagcac ttgtagttgc agctgtggtc ttgggaccac cgcatcaggt
360901 aggggagaga aaaaaaatt tttttttttc ttttttgagac agtgtctcac
360951 tctgtcgccc aggctggagt gcagtggcat catctcggct cactgcaagc
361001 tctgcctcct cggttcacgc cattctcctg cctcagcctc ccgagtggct
361051 gggactacag gcgcccgcta ccacgcccgg ctaatttttt gtattttag
361101 tagagacggg gtttcaccag gttagctggg atggtctcga tctcctgacc
361151 tcatgatctg cctgcctcgg cttcctgaag tgcggggatt acaggctgag
361201 ccactgtgcc cggccgagaa aaaattttt gaggtgattt tgagaagaaa
361251 gaaaaatgta ttgtcatttt accagtgtac tcctttcttg gtgagacctg
361301 cgtagtcatc tcagcattct ccccactccc ttttcccaga tcaaccagaa
361351 aaacagagaa aaaatctaac aggagcactc tagtttcaac cacgttgagt
361401 ataagccagg ctttcatgct tttatcttcc ctggttttag acaaccaata
361451 ttttaattgc ccattctact tatctatcaa actattactc taaggaggat
361501 atctctctgc ccattgttgg gcattatggg ctgtacagtg tgttcctttg
361551 tctgaagaag aaatgatggt cagccatcca aatccttgaa atatcttctg
361601 ttgtttattt ttttaattt tttttttatg gcactctgaa cactttcatc
361651 ttccattgga taagcaaagc ctgcactaga gtcagtgtct attcctatca
361701 agaattccta ttccatttgt agtcccccag ggctgccagc atcagtctca
361751 cttgccagct atgttcaggg ccttccacc aggaaatctt tcccatagcc
361801 agtttctgtc tctcttactg agaaacagaa cagttcttcc tagcattttg
361851 tgccttggaa ttgccatcca taaccaaga agctcttgtt tggtcagttg
361901 aaagttgttt atttggcact gtagaatcca gcagtttctc acacagttcc
361951 agagtcagtc ctaggggaaa agaaattctc tgcatgcctt gagtagcatg
362001 atcctctata aaccatttcc attgtgtcat ggaactcttc tgggcactgc
362051 catccccatt agaatgttcc tctgacatca tctgagacag catgcctatt
362101 tcaggtatca gtgggtggc ttcagtaaat gtttcattgc gagtcagtaa
362151 atgcccttca agtggaaatt ctctagtcca aagtcccagt ggttgttgct
362201 gggaggtgcc cacaggcttt tgccataagc tccaggaaat gctccataga
362251 gggttatcaa gtgagaatt tgtccctacc agcaccgtag cttctactct
362301 gcactgtgtg ggcctgggca gtctccctgg ttccagctta gcatgtccaa
362351 ataatattgc ttgaagggac gatttacatg ccttctcttt tacagtacca
```

FIG. 7 CONT'D

```
362401 ggtagggaaa acagtccccc acacagatac aatgttcatt cccatgataa
362451 aatcagataa aaaatgcaac tacttcacat gaagtgttca aatataccaa
362501 ctttcatagt cctatcgacc cctacatttt tctgttttag tttcaggaac
362551 ttttcttctc caccectaga ccatttaccc tctcttgtgt aaaagtcttt
362601 gggtacccag ccaaggggtg acccaaagga ccctggccct cttgttaatc
362651 tttatcttgg ttagtctgct cgactattgc cccaggcaaa ttcagatcag
362701 attttcatt gtaactgctg cctttagct ttaaattt ctccaaactg
362751 ggagaaatac agcaaactgg tttggggccc tttaatgttg gaggaccaaa
362801 aggggctccc tttggttcac ccaaccttca gggtagtgtt acgttaagac
362851 ctttgtttta actccatcaa tttccttttt attgttgtta ttttttacag
362901 atgggggtct caatatgttg gccaggctag tcttgaactc ctaggctcaa
362951 acgatcctcc tacctcagcc tcccaaattg ctgggattac aggtgtgagc
363001 caccatgtgc agccaaccgc atcaatttcc attttattca ttccatttct
363051 taataaccat ctaaagattc ctaccctgct gggaccagtc ccctcttgct
363101 gccgccgctg ccttctcctc ctcctcctcc ccattccct cccctcctc
363151 cccttcctcc tcctcctcct ttcttgctgc tgcttcttca gctgctgctt
363201 ctgctgctgt tgcttctgca tctgcttctg ctggtgctgc tgcttcttgc
363251 tgctgctgct gcttctgctt cctcttcttc ctcttcctct tcttcctttt
363301 tcttctcctt tcttctcctt tgtctcattt cttctccttc ttccttctcc
363351 tcctcttccc tcctcctcct tccttcctct ttcttcttct ttcttctttc
363401 ctctccttct ccctctcctt ctcctccttc tcctcttcca gtccctccct
363451 ccttccctcc ctccttccct ctctccttcc ctccttccct tccttccctt
363501 cctttccttc ccttccttcc ttctttcctt tccttttttt ttttttttt
363551 tttctgagat ggagtctcgc tctgtcacct aggctggagt atagtggcat
363601 gatcatggct cactgtagca tcgaccttct gggctcaagt gatcctctca
363651 cttcagtctt cgagtagctg ggaccacagg tttcttgtag tgtccaggaa
363701 ccatctcttc atgttcttta ttgtcaatgt atcattcctg tttagtttca
363751 tgtctcccac tgtgagaaac aagtagcatt ctgttattac tcacatgcca
363801 ccatggttct tcattatctt aatgtattga acaacatag atcttcttgc
363851 cctgcattta tttaatgctg attgcatcaa aactcattag gctacatcct
363901 tcatcatgct gcccaagaat actggcttct aatgactctc tcacaggtta
363951 tggtactgcg atcatgacca caaacacagg gtttacccag attatgcagg
364001 aaaaaaagaa aaatactttg ttttcttgtc atgctaaatt tattgtttgg
364051 gaatttttc aagagaagac caggtcttct cttgaactct ttaaactata
364101 aactttatat tcctagaacg ttcctctgtt gaccacatac ctacctttca
364151 cacaccatca ctggtaggga ggattggtga gaggctctcc tctttacaca
364201 aggaatgtcc gttatttgac cagcagagct taagatcaac cagggagatc
364251 atgatgtcat caagttaata ggaagcagga gaggatattg attaaaaggg
364301 ctgactgaca ttgtagaggc atggtctcaa aagccttcaa gggagatagg
364351 cactgccact cctgaaggat tgcctgacat gaggtgcaga gcctgtgtgt
364401 tgtggggtga ctgcattgag tgtcagtgac atgaggtaca tggggtgctg
364451 taggatacac agatccacac acatggctca agctcaaggg ttgatagtga
364501 accacaggta gcccagagcc aagagttatt aaaaatcagc atgttatcac
364551 catttgacaa cccaatcttg cacaatctct ggaaagaaat actgtgccaa
364601 caggagcaat tcactttcca ggtctccttt ttggattcca gctctgattt
364651 ttgtatcttc tcagggcatc tggtccatcc caagtatggg atagagggtt
364701 gtagattacc ccaaaaggaa aaagcagaaa ctaggacaca cacaggtccc
364751 agtgtgggat gggggcacct cacgtggatg gatctgatag cccttgtcag
364801 tcccagggat cagagggaga ctcagaaaac tgtgaggaag atacccaaa
364851 atacagggcc ccctggaaca aggaagccag ggaagagtgc cctgctgcct
364901 agattgaagg gctgaagtaa ttttagggca acaaagttga tgatagaaag
364951 ttctctatta ctgaagaatt ctagtggtta aaggaactaa tgaaataatg
365001 gatcattaat gtatggtaaa actataacct gaataagcct agtatcacta
365051 aaagtggaaa acctgacatt gtgtctccta atgtgatgca ataagaaaac
365101 agcaccactt gcaaagtatt cctgccttaa aagctgaacc tgaatctgat
365151 gaaatttcta tatttatttt tcagtctata aaaaatatgg gggtaaagaa
365201 caagttaaat aactgttaga gtgcagtcag ctaaatacag aatgtgggac
365251 tgtcaagagc tgtgcaaggc ctgggatttt gccccactta taaactaaca
```

```
365301 agttagcctg ttttggtttc atggatgctg gcaggagaca gaagattcct
365351 gagtcagaga caaaggattt tattgcccac agcaaaagta gtattcagaa
365401 cttcgtgttt gtttgtgtca gtctccatgc cccacaaagc ttattggaag
365451 tgacacaaag ggctcgtgat ggatgcctta gaatgtagtt ggttgcatta
365501 gaggaaagaa acactgagtt tggggcattc attgttttta aggcaagtgg
365551 aagccagcct gctgtttcgg ggagatatta ccccatcctt caggtttgct
365601 tgctgcaaac acaatcttga gaaatggccc tggtaaagaa tggtcagggc
365651 tttgcattct tggtatgcct agcaaaaata tatggggata ctcaaggcca
365701 gtgacagatt gcctgttgga aaaatacacc ccttagccca atatgttctt
365751 gaccaaactt gagttttttac acaagcttgc cactccatca gccactctga
365801 ctaatatgac cagagaggtt gggagcaaaa ccatttcatt tgtctctcct
365851 aggagtttta tagtttcagg tcttatgttc aggcctttaa cacattttga
365901 attaatttt gtacatggtg taaagtcatt ttttaaaatt tggacgtaat
365951 cagtttttccc aacatcattt gttgaagaga ctagtctctc ccccattttg
366001 tggccttggc accctcgtca aatatcattt gacaatatat gtgagggctt
366051 atttctgggc taattcttct gttccattgg tctgtgtgtc tgtctttatg
366101 tcagtataat actatttga ttactgtagc tttgtgatat cttttcaaaat
366151 aggaagtatg agacctccag ctttgttttt cttcctaaag attttttttgg
366201 ctatatggga ttctttgaga ctttatatgc atttcagggt ttttaaattt
366251 tttctgcaaa aacaaaaagc cattggaatt tgatgggaa ttgcatttaa
366301 tttatagatc actttgggta gtattgttat tttaacaata ttaagccttc
366351 caatccatga acatgggatg tcttttccatt tatttgtatc ttcttaaatt
366401 ttttaaagtg atgttttgta gcagtgatac aagaaacagg agggatgaat
366451 taatgatatt ttattattac aagatatact acccatgatg tagtacagtg
366501 ttattggaaaa gtggacttgc attaattata aatgtatact gcaaactcta
366551 gggcaaccac taaagaaagt aaaaaaagaa gtataagtga catgccagga
366601 aggaagagaa catggaatca tataaagtgc tcaattaaaa ccacaaaaag
366651 cagaaaaaca gtggaaaaca aaaacaggaa taaaaacaa gggcaacaaa
366701 tagaaagcag taacaaatat gatatattaa tccaactata tctataatga
366751 ctgtaaatgt taatgatcta aatttttacta agacaaagat tgagtagatc
366801 taaaaacaag acctaactat atgttgtcta caagaaacac attttatccc
366851 aggcacaatg gctcacgcct gtaatctcaa cactttggga ggccaaggtg
366901 ggcaggttac aaggtcagga gtttgaaacc agcctggcca acatggtgaa
366951 accccatctc tactaaaaat acaaaaatta tccaggcgtg gtggtgtgca
367001 cctgtaatcc cagcttttca gaaggctgag gcaggagaat tgcatgaacc
367051 tgggaggcgg aggctgcagt gagccaagat cacaccattg cactcccgcc
367101 tgggtaaaag agcgagactc cttctcaaaa aaaaaaaaaa aaaaaaaaa
367151 aaaaaaggg aaagaaagaa acacatttga aatataagaa catatataga
367201 ttaaaagtaa atggatgaag aaagatatac catgcctata ctaattaaga
367251 gaaagtggaa gtagctatat taattttagg cagagcaaac ttcagagcaa
367301 ggacagatat cagggataag gagggaaatt acataatgaa acagcattca
367351 ataccccaag aagacataat cattctttt ttttttttt ttttgagata
367401 gagttttttct ctgtcaccca ggctgaagta caatggtata atggcacaat
367451 ctcggctcac tgcaacctct gcctccaggg ttcaagcaat tctgtatcag
367501 cctcctgagt agctgggatt acaggcgcct gccaccacac ctggctaatt
367551 ttttgtagtt tttagtaaaa attgggtttc accatgtggg ctaggctggt
367601 cttgaacttc tgacctcagg tgatctgcct gcctcagcct cccaaagtgc
367651 tgggattaca ggcatgagcc gctgcacccc gctgacacaa taattcttaa
367701 tgtgtattca cctaacagca gggcatccaa atatgtaagg gaaaaactga
367751 taaactgca agaagacctg ggtgaatcta ctattatagt tggagacttt
367801 aacactcctc taacagaaat ggacacagtc agcaggcaga aaaccagtaa
367851 ggacacagtt gaattcaaca acactatcaa tcaactgtat ataattgaca
367901 tctacagaat atttcatcca gcagcaggca gcagattaca attcttctca
367951 aaatcacatg gagcattcac caagacagat cacattctgg gccataaaac
368001 acacctcaac aaaatataaaa gaagtcatat agtgtctgct ttcagacctc
368051 atgaaattaa actagaaatt gatatcagaa agatagctga aaatcacaaa
368101 tacctggaga ttaaacaaca tacttctatt ttttttttt ttttgagac
368151 agagtctcac cctgtcaccc aggctggagt gcagtggtgc gatcttggct
```

```
368201 cactgcaagc tccacctcct gggttcacgt cattctcctg cctcagcctc
368251 ctgagtatct gggactacag gcgcccgcca ccatgcctgg ctaatttttt
368301 tgtatttttt agtagagacg gggtttcacc gtgttagcca ggatggtctc
368351 gatctcctga cctcgtgatc cacctgtctc agcctcccag attaaacaac
368401 atacgtctaa gtaatatatg agtgaaagaa aaagtctgat gaagagagtt
368451 aaaaatattt gaaataaatg aaaatataac ttatcaaaat gtctaagata
368501 cagcaaaagc agtgcttaga aatttatagt attgaataca tatattagaa
368551 aagaagattt aaaatcatta atccagcttt cagcttttag ctcagagaag
368601 gccaaggtgc aactttcttc agttgtcatg aatctgagtt catacaacac
368651 cagccatctc caccatgcca tcgaagaaaa aagtaaaata aaataattaa
368701 tccaatattc tgccttagga aactagaaaa agaagagcaa attaaatcca
368751 aataagcaga ataaaataaa tgaaaattat agcagaaatc aatgaaactg
368801 gaagcagaaa accaatagag aaaaataaca cgaccaaaat ctagtttaaa
368851 aaaaatcaat atagttgata aacctctagc caggcttact aagaaaaaga
368901 gaagacacaa ttactaatat cagaagtgaa agagaagcat cactacagat
368951 cccatggaca ctaaaagaat aataaaggaa tattattaat aactctatgt
369001 ccacacattt gataacctac ttaaagacac aatctgccaa aattaacaca
369051 aaaagaaatc aatactttta ataaacctat attgattaaa aaaattggat
369101 taataactaa taaacttcca aaacagaaat caccagactc acatggattc
369151 attagtgaat tctatcaaac atttaaggaa gaattatac caatcctata
369201 caatctgttc cagaagacag aagcagaggg gatacttcct aaatcattct
369251 atgaggctgg cattacccta atattcaaat tagacaaaga cattacaaga
369301 gccgggtgca gtggctcaca cctgtaatcc cacactttgg gaggctatgg
369351 tgggaggatc acttgagttc aggagttcaa gaccagcttg ggcaacatag
369401 caagacctca tctctacttt aaaaaaaaa aaaagtagc tggtatggtg
369451 gcacacacct gtagtcccag ctactcggaa agctgaagtg ggaggatcac
369501 ttgagcccag gagatcaacc ctgcagggag ctatgatcat gccactgcac
369551 tctagtttag gcagcagagt gagtccttgt ctcagaaaaa aaaaaataca
369601 agaaaagaaa acaatagagt aatatctctc atgaacatag attcaaaaat
369651 cctgaacaaa atactagcaa gttgaatcca acaatgtaaa gaaagaatta
369701 cacatcatgg tcaagtggaa tttatccaag gtaggcaagg ctagttcaac
369751 atttgaaaat caattaatgt aatccatcac aacaacaggc taaagaagaa
369801 aaatcacatg gtcatataaa tagatgcaga aaaagcattt gacaaaaaaa
369851 aaacatttca tgattggaaa aactcacaat aaattgagaa tagagatgaa
369901 cttgctcaac ttgatgaaga acatctgcca aaaaacctac agctaacatt
369951 atacttcatg gtgagaaact tgaagatttt ctcacactat cagggacatt
370001 gcaaatatgt ccccttctcac cactgctttt caacatcata ctggaagtcc
370051 tagctaatgc aagaacacaa gaaaagaaa taaaaggcat atagattggg
370101 aaggaagaag taaaattatc tttgtttgca gatgacatga ttgtagaaat
370151 ccaaaagaat caacaaacaa ccctccttga actaataagc aattatagag
370201 ggttgtagga tacaaagtta atgtacaaaa gccaattgcc ttctgataca
370251 ctgtaagcaa tgaacaagca gaatttgaaa ttaaaaacac aataccattt
370301 atatccttct gaaaagaaat aggtataaat cttaacaaaa tatgtggaag
370351 atctatataa gaaaaactac aaactctga tgaaaaatat caaagaagac
370401 ttaaataaat ggagatatag tccatgttca tggataggaa gacccagtgt
370451 tgttgagatg tcagttctga actggatcta tagattcaat gcaatcccaa
370501 tcaaaatcca gtcaagttac tttgtggatg ttgataaact aattctaaag
370551 tttatgtgaa gaggcaaaga cacagaatag ctaactcaac aataaaggag
370601 aagagttaga ggactgatag tacccaactt actagactta ctagaggtcc
370651 cgcatggtgg ctcacaccta taatcccgac tactctaaag tctgaggtgg
370701 gaggatcact tgagcccagg agttgatgtt gataaactga ttctaaagtt
370751 tatgtgaaga ggcaaagaca tagaatagcc aactcaacaa taaaggagga
370801 gaacagttag aggactgata gtacccaact tactagagtt actagaggtc
370851 aggcatggtg gctcacacct ataatcctga ctactcaaaa ggctgaggta
370901 ggaggatcat ttgagcccag gagttcaaga tcagcctgag caacatagaa
370951 agacctggtt tctaacaagt taaaaaaaaa aaaaaaaaa aaaaagact
371001 tatagaaagc tgcagtaatc aagacagtgt gatattcgtg aaatagatca
371051 atgaaacaga acagagagcc cagaaaaaaa cccacataaa cagagccaac
```

```
371101 taaccttcaa caagggagaa aaggcaatac aatggagcaa agatagtctt
371151 ttcaacaaat ggttctggaa caactggaca tccatgtgca aaaataaac
371201 ttaaacatgg actttaaacc cttcccaaaa attaactcaa aatgaatcac
371251 agacctaaat gtaaaatgca aactataaaa ctcctataaa ataacagaga
371301 aaaacttaga tgactttgct gatacagttt ggatgtgtat ccactccaga
371351 tttcatgttg aaatgtgatc cccaatgttg gaggtgggac ctggtgggag
371401 gtatttgggt catggggtg gatccctcat gaatggcttg gtgccctcct
371451 tgagataata catgagttct cactctatta gttcatgcaa aagctagttt
371501 taaaagagcc cggcacctcc tcccctctct cttgctccct ctctcaccat
371551 gtgatacact agctcccctt ttgccttctg ccatgattgt aaacttcctg
371601 aggtttcacc agaagcagat gctggcacta cacttcttgt atagcctatg
371651 gaactgtgag ccaaataaac ctgttttctt tataaattat tcagccttac
371701 atattccttc agggcaacac aaaacagact aacatatatg ggtatggtga
371751 taattttttt ttttttgag atggagtctc gctctgttgc ccaggctgga
371801 gtgcagtggt gcaatatcag ctcactgcaa gctccgcctc ctgggttcac
371851 gccattctcc tgcctcagcc tcccgagtag ctgggactac aggcgcccgc
371901 caccatgcct ggctaatttt ttttgcatt tttagtagag acggggtttc
371951 accgtgttag ccaggatggt ctcgatctcc tgacctcatg atctgcccgc
372001 cttggcctcc caaagtgctg ggattacagg catgagccac tgcgcctggc
372051 tggtgataac tttttagatc caataccaaa attatagttc atgaaagaaa
372101 caattgataa gctgaacttc aacaaaatta aaacttctgc tctgcaaaag
372151 acaacgtcaa gagaatgaga agagaagcca cagactggga gaaaatattt
372201 gcaaaagaac catctgacaa aggactctta tccaaaatac acaaagaaat
372251 cttaaaattc aacaataaga aaatgagcag cccaattaaa aaatgggcaa
372301 aagacctgaa cagacaccta atcaaagaag atatacagat agcaagtaaa
372351 catatgaaaa gatttaaaca tattcatca ttagagaatt gcaaataaaa
372401 acaatgggct atcactacac atgtattaga ataactaaaa tccaaaacac
372451 tgacaatacc aaataatggc aaggacatgg agcaacagga atattaatcc
372501 ttgctgatgg gaatacaaaa tggtacagct tcctcagaag acagcagctt
372551 cttataaaac taaaaagtta taaactttt accatacgat ccagcaatgc
372601 acgccttatt atttacccaa ataaactgaa aatttgtgtc cacacaaaca
372651 cctgcacatg gatgtacata gaagctttat tcatagtcgc caaaagttgg
372701 aagcaaccaa gatgtccttc agtaagtgaa tgataaataa actgaggtat
372751 atctagacaa tggaatatta tttagcagta aaagaaatg agatatcaag
372801 ccataaaaag acatggaaga aacaaatgct tatcactgag tgaaataagc
372851 tgatctaaaa ggctgcatac tgtatgacac aactatatg acattctgga
372901 aaagacacaa ctatggagac aataaaaaga tcagtggttg tcaggggttg
372951 ggagaaaggg aggtatgaat aggtgaaaca cgggactttt ttagggcagt
373001 gaaacaatgc tgtataatac tgcaatggtg aatatgtcat tatacatttg
373051 tcaaaattca tagaaagtat aacaccaaga acgaacacta ctgtaaagta
373101 tggactttgg gtgataatga tgtgtaattg tagggccatc agttgtaaca
373151 agtgtaccat tatggtatgg gatgctgata gttggggaga ttgtgttgtg
373201 ggggaacagg gtatatggga actctctgta ttttctgctc aatttggcta
373251 taaacctaaa actgatctaa aaactaaagg ttattaatta aggaccaaat
373301 gagggtcgag tgcggtggct catgcctgta atctcaacac tttgggaggc
373351 tgaggtgggt ggatcacgag gtcaggagtt cgagaccagc ctggccaata
373401 tggtgaaacc ctatctctac taaaaataca aaaattagct gggcgtggtg
373451 gcatatgcct gtagtcccag ctactcagga ggctgaggca ggagaattgc
373501 ttgaacccgg gaggtggagg ttgcagtgag ccgagagcac accattgcac
373551 tccagcctgg cgacagagtg agactccatc tcaaaaaaaa aaaacaaaaa
373601 aaaaaaacaa agtttatacc aggaatttaa aggtggttca acatctgaaa
373651 atcaattgat ataattcatc aatagaatag atgaaaagaa aaagaatgc
373701 tcttattagg tatagaaaaa gcatttgaca aaattcatca tccattcatg
373751 attaaaccaa tcaaacaaca aactccacaa aaaacttctt ggaaactaag
373801 aatataaggt cacttcctta atctaagtgg catctacaaa aaaaactact
373851 gctaatatca tacttaatgg cgaaaggcaa gaaaagaaa taaaaggcat
373901 acaaattgta aaggaagaaa caaaatggtc tctatttgca gacagcatga
373951 ttatctatga agaaattcct aaagaatcta caataaaact gttggattaa
```

FIG. 7 CONT'D 374001 tacaagttta gcaaggtcac aggatacaag gttaattaaa aagagtcaat
374051 catatattcc tgtataacag caatgaaaaa ttagaatttg aaatttaaaa
374101 ggcagcacca tttaaaatag ctcaactaac aattaagagc ttaggtataa
374151 atttaaggca tatgtacagc atccatatgc tgaaacctac aaaacattga
374201 tgaaataaag aagatctaaa taaatgtaca gataaagtgt ctatatggct
374251 tggaaggctc aatatgatta agatgtcatt cttccacaaa cagcacaatc
374301 tcaaggaaat ctcaggcaca tttttagata ctgacaaatt gattcaaaat
374351 ttatatggaa gctgggcgtg gtggcttata cctataatcc cagcactttg
374401 ggaagccaag gtgggcagat cacttgagcc caagagtttg agaccagcct
374451 gggcagcaac atagagagag cctgtctcta tttaaaaaat aaataaataa
374501 ataaataaat aaataaataa ataaataaat aaataaataa aatggaaaag
374551 gtaattaaac tacaggagcc aattttttt ggttttggt ttcttggttt
374601 tttttgttgt tgttgttcgt tttttttttt tgagacagtc tccctctgtt
374651 gcccagacgg gagtgcagtg gtgcaatctt ggctcactgc aacttccggc
374701 tcccaggttc aagtgattct cctgcctcag ccttccaagt agctgggatt
374751 acaggcaccc accaccacac ttgggtaatt tttgtatttt taatagagag
374801 ggcgtttcac catgttggcc aggctggtct caaactcctg ccctcaagcg
374851 atccgcccag cttggcctcc cagactgctg ggattacagg catgagccaa
374901 tacacctggc ccatttttt tttttaaata aaacaacaac aaaagaacta
374951 agttggagga cccacactac tttaaggctt actgtaaagc tatagtaatc
375001 aagacagcat ggtattgttg aaagaataga cacgtatata cattaaacag
375051 aataaacggc ccaaattaaa cttacacaaa tatagtcaac agattttttg
375101 acaaaagttc aaaggcaatt caatagagaa ggaacagttt tttcaacaaa
375151 tggtgctaga atgattcttc atccatatgc aaaaaaggaa cctcaacaca
375201 taattcatac cttatacaaa aattatttca aagtggttta tagacctaaa
375251 tataaaatat aaaactataa aacgtctagg agaaagtgta agagaccttg
375301 agtttgacta tgaggtatgt ttgtttgttt ttttgagatg gagtttcgct
375351 ctagtcactc aggctagagt gcaatggcgt gatctaggct cactgcaacc
375401 tccgcttccc gggttaaagc gattctcctg cctgagcctc ccaagaggct
375451 gagattacag gcatgcgcca ccaggcccag ctaatttttg tatttagta
375501 gagacggggt ttcaccatgt tgcccaggct agtctcgaac tcctgacctc
375551 aggtgatcca ccctccttgg cctcccaaag tgctgggatt acaggcgtga
375601 gccaccatgt ccggccaact atgagtattt aaatatgaca ccaaaagcac
375651 aacccatcaa agaaaaaaat gagaaattga gttttacgaa aattaaagac
375701 ttttgtgggc tgagcatggt ggctcatgtc tgtaatccca gcactttggg
375751 aggctgaggc gggtggatca cgaggtcagt agttcgagac cagcctggcc
375801 aacatggtga aacaccatct ctactaaaaa tacaaaaatt agctgggcat
375851 ggtggcaggc gcctgtaatc ctagctactt gggaggctga agcaggagaa
375901 tcacttgaac ccaggaagca gagtttgcag tgagccaaga ttgcgccatt
375951 gcactccagc ctgggtgaaa gtgcgagact gtgtctcaaa aaaaaaaaa
376001 aaaagacttt tgctttgtat aaaaatctgt gaagagaatg aaaatacaag
376051 ccatagacaa ggagaaaata tttgcaaatc acatatccaa taaagagttt
376101 gtatctagaa tatataaaga actctttagc cataacaata ataaacaaa
376151 taattaaact taaaactgtg caaatgtctg tcttccccaa agaagatgta
376201 tggatggcaa ataaacatag ggaaagatat tcaacatcat tagtcatgaa
376251 ggatatgcaa attaaaacca caatgggata ccactatgca cctattacaa
376301 tggctaaaat aaagaactga atacaaaata ttggccttga tgtggagtaa
376351 cagagtcatt cattgctggt ggaaatacaa aatggtacag ccactttgga
376401 aaaacaaatt tggcagtttc ttataaagtt aagcatatac ttatgtgacc
376451 cagcaatctc acttctaggt atttatccaa gtgaaatgaa agcttacatt
376501 catacaaaaa catgtatatg actagttata cataattttc ccaaaatgag
376551 caatcgaaaa tgataaattg tgataatcca tataatggaa tactactcag
376601 caataaaaag gaacagatta ctgattcata caaaaacatg ggtgaatctt
376651 aaaatgcatt ttcctaagaa gatcattatt ggggctggt gatgggtaca
376701 ggaggattga ttattctatt tttgtgtgtg attgaaaatt tccataataa
376751 aagttttaaa agtgtatttt aatacggtat tttttaatga tatcacaatg
376801 tccaggtact gcacagatga gactgaagtt ccacgttcta aagccagaag
376851 ctgcatctga aatgttgcat agaaaactgc tcattggctg ggcgcggtgg

FIG. 7 CONT'D

```
376901 ctcacacctg taatctcagc actttgggag actgaggcgg gcggaccacg
376951 aggtcaggag atggagacca tcctggctaa cacagtgaaa ccccgtctct
377001 acttaaaata caaaaaatta gccgggcgtg gtggtgggtg cctgtagtcc
377051 cagctactcg ggaggtagag gcaggagaat ggtgtgaacc cgggaggcgg
377101 aacttgcagt gagccgagat cacgccacag cactccagcc tgggcgacag
377151 agtgagactc catctcaaaa aaaaaaaaac aaacaaaaaa cttaggtggg
377201 catggtggca ggcacctgta atcccagcta cttgggaggc tgaggcacga
377251 aaaatcgctt gaaaccagga ggcagaggtt gcagcgagct gaaattgcac
377301 cattgcactc cagcctgggc gacagagcga gactccatct caattaaaaa
377351 caacaacaac aacaacaaac tgctcattac ataaagatcc aatctggtaa
377401 tataaatttt attttattaa gatatatact tagcactttg aattgcttca
377451 aacataattt gaggggaaca aagacttatt ggcttgttgg ttttaagaac
377501 tgaatttgcc taggcattag aaaaagtaca gaaagctccc cagagcagtc
377551 tagagcccag cagtcgcagg ccctaggcc atttgagtta taggacagaa
377601 ggtgggggtg tcagtgaaca ctattccttc tgagtgtctg tcaatggagg
377651 ttgcatgtga acaggaaag aggtttgctg aggctctatg tttatgtttg
377701 ccttttcttc aactggagac tgaagtttga gaatagcaag taagcacgta
377751 atcattctcc tagatctcat tacttgagat ctttttttt ttttttttg
377801 agacagggtc tggctctgtt gcccaggctg gagtgcaatg ggacaatctc
377851 agctcactgc aacctctgcc tcccaggctc aaaccatctt cccatctaag
377901 cctcccaggt agctgggacc acagccgtgt gccaccatgg tggggtaatt
377951 tttgtatttt tggtagagac agggtttcgc catgtcaccc aggctggtct
378001 tgaattccta gcttcaagca atcctcctgc ctcagcctcc cagagtaaag
378051 gcgtgagcca ctgtgcttgg cctgagataa tttcttaaga tgatgtataa
378101 tacctcccgc aatgatagct tccccgatgt aacacctcct gcaagttgtc
378151 ctgagctatt ttaagctgta atcagaatat attgaagatt caacattttt
378201 attgtccttg tcctgtaccc ccagcaataa aaaaaaaaa aagacttaaa
378251 aaaattatgg ggcctatcgg ctgggtgtgg tggctcatgc ctgtaattgc
378301 agcactttgg gaggctgagg tgggcggatc acctgaggtc gggagttcaa
378351 gaccagcctg accaacatgg agaaactcca tctctactaa aaatacaaaa
378401 ttagccaggt gtggtgagca tgcctgtaat cccagctact gggaggctg
378451 aggcaggaga atcacttgaa cccgggaggc ggaggttgca gtgagccaag
378501 atcaagccat tgcactccag cctgggcgac aagagcaaaa ctccgtctca
378551 aaaaaaaaat tatggggccg ggcgcggtgg ctcagtccta taatcctagc
378601 actttgggag gtagaggtgg gcaggttact ggagcccagg agttcaggac
378651 cagcctgggc aacattgtga aaccctgtct ctacaaaaaa gctactctgg
378701 aggctgaggc aggaggactg cttgagcccg aggttgaggc tgcagtgagc
378751 cgagattgtg ccaccgcact ccagcctggg tgacagaaca agactccgtc
378801 tcaattaaaa aaaaaaaaaa ggaaatttct gaagtgatag taatgttcta
378851 tgtctcgata gcaatttggg atacaaaggt ataggcattt attattatta
378901 aaacttggaa atttacacac aagcacataa gatttataca tttcattgta
378951 tacatatttt acttcaaaag aaaaagtca acaaatattt aacctagtca
379001 atgatataca tgctgagtta tttaggcgga agtctactga tgtctacaat
379051 ttacttttaa atgcgcccaa aaaaaaaaa aacagggatt gacgaatgct
379101 tagagaaagg tacagacatg tgataagcca actatagtga aatgttagtg
379151 gtagtctaca tggtaggtat atgctgttca ctataaaatt ttttcaactt
379201 tgctctgttt gcaaattttc acaataatat attggggaaa tgtctagaaa
379251 tgtgatgcta ccctaggtca gcaggaactg tgaaagatta gacctgtatt
379301 ctggttccca gatgctagag ccttttatttt ttttgggggg gtggaggtgg
379351 agtctcactc tgtcgcccag cctggagtgc aatggtgtga tctcggctca
379401 ctacaacctc cacctcccgg gttcaagtga ttcccctgcc tcagcttccc
379451 aagtagctgg attacaggca ccttccagca tgcccagcta agttttgta
379501 tttttagtag agacggggtt tcaccaggtt tgtcaggccg gtctcaaact
379551 tgatccaccc gcctcggcct cccaaagtgc tgggattaca ggcgtgggcc
379601 accacgtcca gcctgctaga gtctttttata cttgatataa tttcttgaat
379651 tc
```

FIG. 7 CONT'D

Domain architectures of CLLD8, NY-REN-34 (ANGE) and related proteins, drawn approximately to scale.

FIG. 9
Expression of CLLD8/NY-REN-34 (ANGE) gene complex
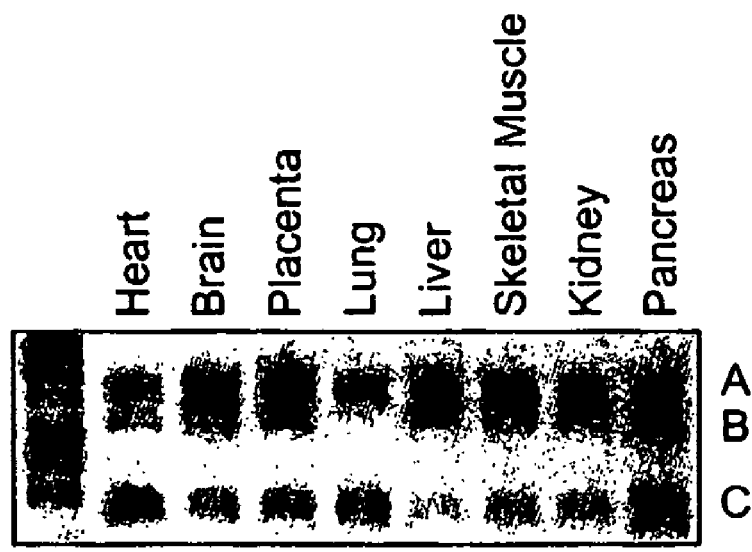
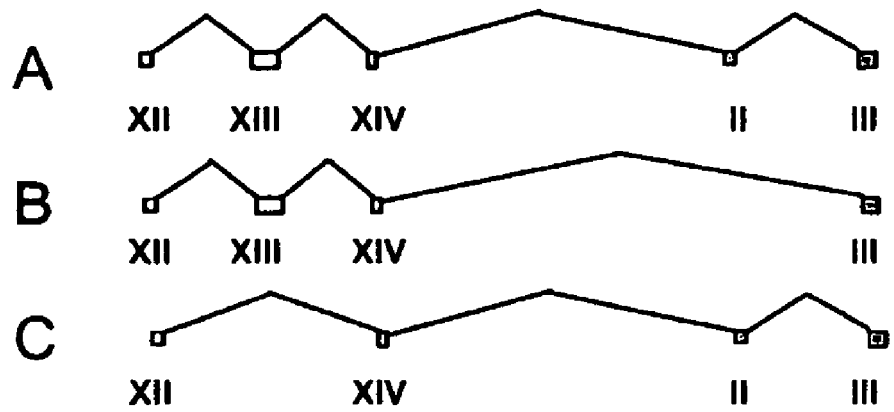

Northern blots of gene for NY-REN-34 (ANGE) and CLLD8

FIG. 13
a) NR1 (REN34 promoter)
Left to right: NR1WT, NR1WT+MG63, NR1MUT, NR1MUT+MG63
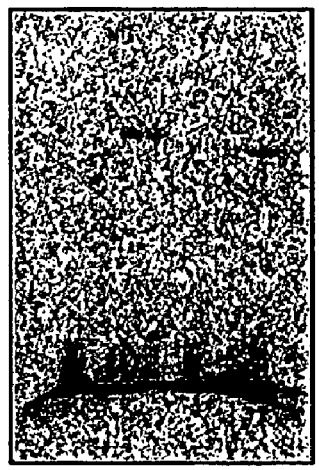
b) NR2 (CLLD7 promoter)
Left to right: NR2WT, NR2WT+Jurkat, NR2MUT, NR2MUT+Jurkat

c) NR3 (CLLD7 promoter)
Left to right: NR3MUT,NR3MUT+MG-63,NR3WT,NR3WT+MG-63
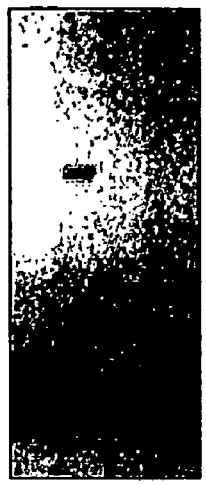
d) NR4 (CLLD8 promoter)
Left to right: NR4WT,NR4WT+PC12,NR4MUT,NR4MUT+PC12
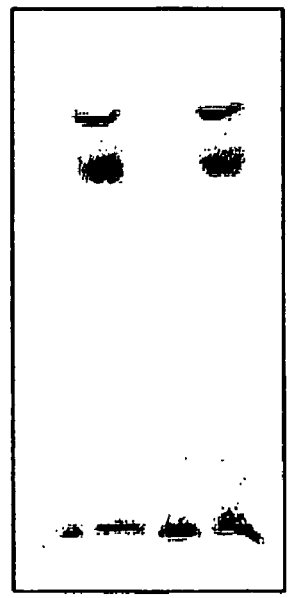
FIG. 13 CONT'D a)
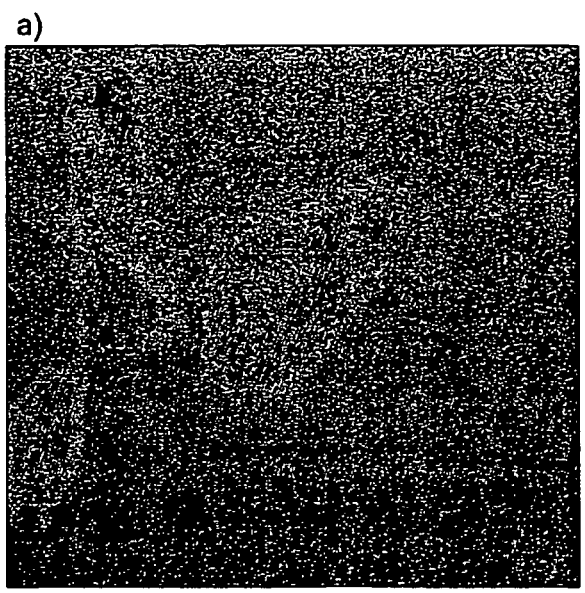
b)
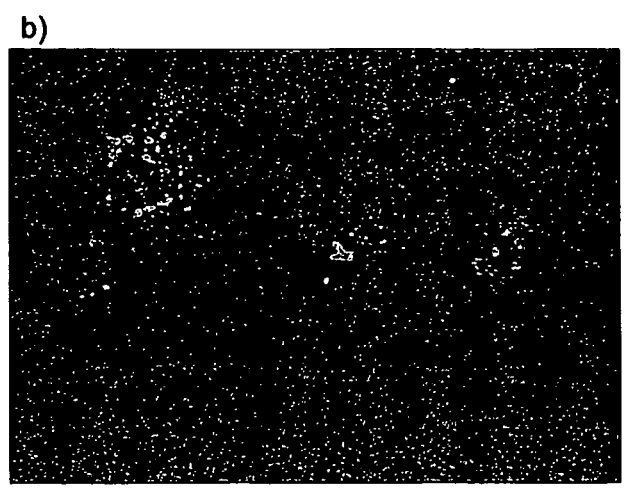
c)
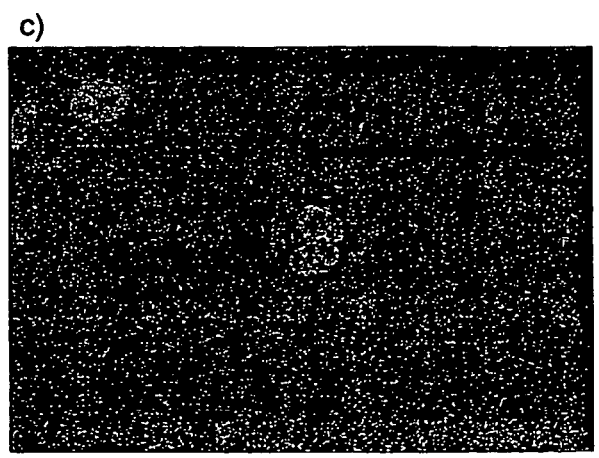
FIG 14

Table 1

Association between Qts and SNPs a) BAC BA101D11

| MARKER | POSITION | P Values from QTDT | | | | | |
|---|---|---|---|---|---|---|---|
| | | LnIgE | PSTI | LnIgE STI as covariate | STI LnIgE as covariate | LnIgE 4_2 as covariate | STI 4_2 as covariate | LnIgE 38_1 as covariate | STI 38_1 as covariate |
| 101283b16_1 | 449 | | 0.0330 | | | | | | |
| 101283b16_2 | 685 | | | | | | 0.0240 | | 0.0350 |

Table 1
b) BAC BA103J18.03548

| MARKER | POSITION | P Values from QTDT | | | | | | |
|---|---|---|---|---|---|---|---|---|
| | | PSTI | | STI lnIgE as covariate | | STI 4_2 as covariate | | STI 38_1 as covariate |
| | | LnIgE | LnIgE STI as covariate | | LnIgE 4_2 as covariate | | LnIgE 38_1 as covariate | |
| 101660b13_1 | 155075 | | | | | | | |
| 101063b15_1 | 164307 | | | | | | | |
| 101458b10_1 | 182579 | | | | | | | |
| 101094b11_2 | 231215 | | | | | | 0.0420 | |
| 185316b2_1 | 297898 | | | | | | | |
| 185316b2_2 | 297860 | 0.0076 | | 0.0015 | | | | |
| 185316b1_2 | 300838 | 0.0017 | | 0.0360 | | | 0.0120 | |
| 185316b1_1 | 301185 | 0.0340 | | 0.0140 | | | 0.0026 | |
| 185306b7_3 | 317115 | 0.0093 | | 0.0220 | | | 0.0313 | |
| 185306b7_2 | 318304 | 0.0040 | | | | | 0.0110 | |
| 185306b7_1 | 318308 | | | 0.0380 | | | 0.0042 | |
| 185752b4_1 | 338162 | 0.0015 | | 0.0290 | | | 0.0002 | |
| 185752b4_2 | 338679 | 0.0034 | | 0.0032 | | | 0.0028 | |
| 185752b4_3 | 339505 | | | 0.0074 | | | | |
| 154016_5S | 339679 | 0.0430 | | | | | 0.0061 | 0.0350 |

Table 1 cont'd

| | | | | | |
|---|---|---|---|---|---|
| 185752b5 1 | 345206 | 0.0029 | 0.0210 | | 0.0050 |
| 185752b5 2 | 345771 | 0.0005 | 0.0040 | | 0.0006 |
| 185752b5 3 | 346362 | 0.0029 | 0.0210 | | 0.0026 |
| 185752b6 1 | 350507 | 0.0041 | 0.0240 | | |
| 44593 15 | 350770 | 0.0015 | 0.0130 | | 0.0073 |
| 185752b6 3 | 351465 | 0.0025 | 0.0150 | | 0.0034 |
| 185752b6 4 | 351804 | 0.0053 | 0.0240 | | 0.0041 |
| 432343b33 2 | 399191 | 0.0075 | | | 0.0089 |
| 432343b33 1 | 399717 | | | | 0.0140 |
| 432343b32 2 | 401694 | | | | |
| 154016 9R | 346769 | | | | |
| 154016 1S | 313625 | | | | |
| 154016 4S | 335681 | | | | |
| 154016 4R | 335560 | | | | |
| 154016 4R2 | 335668 | | | | |
| 154016 4Ins | 335679 | | 0.0480 | 0.0490 | |
| 154016 5Y | 338728 | | | 0.0220 | |
| 154016_1A.1Y | 314883 | | | | |
| 154016_1A.2Y | 314849 | | | | |
| 154016_5S | 399680 | | | | |
| 432343b32 1 | 402491 | | 0.0210 | | |

Table 1 c) BAC bA236M15.0030

| MARKER | POSITION | P Values from QTDT | | | | | | |
|---|---|---|---|---|---|---|---|---|
| | | LnIgE | PSTI | LnIgE STI as covariate | STI LnIgE as covariate | LnIgE 4_2 as covariate | STI 4_2 as covariate | LnIgE 38_1 as covariate | STI 38_1 as covariate |
| 4321031b43 | 30907 | 0.0200 | 0.0062 | | | | 0.0170 | | 0.0250 |
| 4321031b43 | 31147 | | 0.0073 | | 0.0140 | | 0.0170 | | 0.0480 |
| 1895799_1 | 76790 | | | | | | | | |
| 143317_1 | 81615 | | | | | | 0.0150 | | |
| 4321017b38 | 108259 | | 0.0120 | | 0.0240 | | 0.0150 | | |
| 4321017b38 | 109085 | | 0.0090 | | 0.0140 | | 0.0048 | | |
| 195226b35_1 | 183672 | | 0.0021 | | 0.0060 | | 0.0056 | | |
| 1951054b37 | 197991 | | 0.0031 | | 0.0046 | | | | |
| 1951054b37 | 198562 | | | | | | | | |
| 236969b17_1 | 227369 | | 0.0070 | | 0.0140 | | 0.0100 | | |
| 236717b28_1 | 265325 | | 0.0310 | | | | 0.0250 | | |
| 236717b28_2 | 265725 | | | | | | | | |
| 2361170b26 | 364495 | | | | | 0.0230 | | 0.0320 | 0.0290 |
| 2361170b26 | 364858 | | | | | | | | |
| 626789_3 | 128859 | | | | | | | | |
| 626789_1 | 132421 | | | | | | | | |
| 626789_2 | 129231 | | | | | | | | |
| 1895799_3 | 97972 | | | | | | | | |
| 5133822_2 | 27156 | | | | | | | | |
| 1895799_1 | 76790 | | | | | | | | |
| 143317_1 | 81615 | | | | | | | | |
| 5133822_1 | 27143 | | | | | | | | |
| 1895799_2 | 97969 | | | | | | | | |

Table 2A
SNP/Marker Associations with Total Serum IgE (LnIgE)

| MARKER | SNP NAME (Cross Ref to Table 1) | BASE CHANGE | POSITION | P (QTDT) LnIgE |
|---|---|---|---|---|
| 101063b15_1 | 101063B15.1 | C/G | 164308 | |
| 101458b10_1 | 101458B10.1 | A/G | 182663 | |
| 101094b11_2 | 101094B11.2 | A/G | 231215 | |
| d8ex7 | d8ex7 | A/G | 294172 | 0.018 |
| 185316b2_2 | 185316B2.2 | A/G | 297860 | |
| 185316b2_1 | 185316B2.1 | G/T | 297898 | NS |
| 185316b1_2 | 185316B1.2 | C/G | 300838 | 0.0076 |
| 185316b1_1 | 185316B1.1 | A/G | 301185 | 0.0017 |
| d8in12 | d8in12 | C/T | 305881 | |
| d8in13 | d8in13 | A/G | 308393 | |
| 185306b7_3 | 185306B7.3 | C/G | 317115 | 0.034 |
| 185306b7_2 | 185306B7.2 | A/G | 318304 | 0.0093 |
| 185306b7_1 | 185306B7.1 | A/C | 318308 | 0.004 |
| 154016_2R | 154016_2 | A/G | 324399 | 0.016 |
| 185752b4_1 | 185752b4.1 | G/T | 338162 | |
| 185752b4_2 | 185752B4.2 | A/G | 338770 | 0.0015 |
| 154016_in5r | 154016in5 | A/G | 338997 | 0.0043 |
| 185752b4_3 | 185752B4.3 | C/G | 339509 | 0.0034 |
| 154016_5S | i154016.5 | C/G | 339679 | 0.043 |
| Angein7 | angein7 | C/T | 341533 | 0.003 |
| 185752b5_1 | 185752B5.1 | A/T | 345206 | 0.0029 |
| 185752b5_2 | 185752B5.2 | C/T | 345743 | 0.0005 |
| 154016_319 | 154016_319 | A/G | 346363 | 0.0011 |
| 185752b6_1 | 185752B6.1 | A/G | 350507 | 0.0041 |
| 44593_15 | 44593_15 | GAAAGATGATAAAGT | 350770 | 0.0015 |
| 185752b6_3 | 185752B6.3 | A/G | 351465 | 0.0025 |
| 185752b6_4 | 185752B6.4 | C/T | 351804 | 0.0053 |
| 432343b33_2 | 432343B33.2 | C/T | 399283 | 0.0075 |
| 432343b33_1 | 432343B33.1 | A/G | 399823 | |
| 432343b32_2 | 432343B32.2 | C/T | 401694 | |

Table 2A cont'd
SNP/Marker Associations with Total Serum IgE (LnIgE)

| MARKER | SNP NAME (Cross Ref to Table 1) | BASE CHANGE | POSITION | P (QTDT) LnIgE |
|---|---|---|---|---|
| 432343b32_1 | 432343B32.1 | A/G | 402491 | |
| 51338222_2 | i51338222.2 | G/T | 427516 | |
| 4321031b43_1 | 4321031B43.1 | A/G | 430907 | 0.02 |
| 4321031b43_2 | 4321031B43.2 | A/G | 431147 | |
| 1895799_1 | i1895799.1 | C/T | 476787 | |
| 143317_1 | i143317.1 | A/C | 481729 | |
| 4321017b38_3 | 4321017B38.3 | C/T | 508259 | |
| 4321017b38_1 | 4321017B38.1 | A/G | 509085 | |
| 626789_3 | i626789.3 | C/T | 528859 | NS |
| 195226b35_1 | 195226B35.1 | A/G | 583672 | |
| 1951054b37_1 | 1951054B37.1 | C/T | 597991 | |
| 1951054b37_2 | 1951054B37.2 | C/G | 598562 | |
| 2369969b17_1 | 2369969B17.1 | A/G | 627368 | |
| 2367717b28_1 | 2367717B28.1 | G/T | 665326 | |
| 2367717b28_2 | 2367717B28.2 | C/T | 665725 | |
| 2361170b26_2 | 2361170B26.2 | C/T | 764495 | |
| 2361170b26_1 | 2361170B26.1 | C/G | 764858 | |

Table 2B

Association of common b4_2.b5_3.b43_1 haplotypes to total IgE in subject panels

| Haplotype | AUS1 | | | AUS2 | | | UK2 | | | ECZ* | |
|---|---|---|---|---|---|---|---|---|---|---|---|
| | freq | p (mul) | p (ind) | n (freq) | p (mul) | P (ind) | freq | p (mul) | p (ind) | freq | p (mul) | p (ind) |
| A 2.1.1 | 0.449 | 0.011 | 0.014 | 0.396 | 0.12 | 0.078 | 0.378 | 0.0039 | 0.0153 | 0.294 | 0.0012 | 0.0001 |
| B 1.21 | 0.22 | | ·· | 0.229 | | ·· | 0.198 | | ·· | 0.177 | | ·· |
| C 1.2.2 | 0.193 | | ·· | 0.238 | | ·· | 0.192 | | ·· | 0.234 | | 0.0019 |
| D 2.1.2 | 0.084 | | 0.005 | 0.077 | | 0.036 | 0.09 | | 0.0012 | 0.113 | | ·· |
| Haplotype | n=296 | | | n=533 | | | n=323 | | | n=531 | | |

*RAST index included as a covariate

Table 2C

| SNPs | SNP Location | Allele freq | Atopy Chi Squared | Asthma Chi Squared | Atopy and Asthma Chi Squared | Atopy P value | Asthma P value | Atopy and Asthma P value | Atopy Obs:exp | Asthma Obs:exp | Atopy and Asthma Obs:exp |
|---|---|---|---|---|---|---|---|---|---|---|---|
| CLD802 | Exon 4 | 0.553 | 0.81 | 0.5 | 1.59 | 0.305 | 0.447 | 0.162 | 574:584 | 329:335 | 255:264 |
| CLD803 | Intron 7 | 0.692 | 8.64 | 2.48 | 10.64 | 0.003 | 0.106 | 0 | 716:744 | 440:452 | 337:359 |
| CLD807 | Intron 13 | 0.703 | 9.78 | 5.41 | 12.79 | 0.003 | 0.019 | 0 | 844:877 | 509:528 | 392:417 |
| ANGE01 | Exon 2 | 0.353 | 2.76 | 3.71 | 6.57 | 0.089 | 0.077 | 0.013 | 421:403 | 255:239 | 202:183 |
| ANGE02 | Intron 2 | 0.291 | 2.01 | 0.7 | 2.35 | 0.149 | 0.456 | 0.144 | 311:325 | 180:186 | 137:147 |
| ANGE08 | Intron 3 | 0.392 | 2.58 | 1.42 | 4.55 | 0.095 | 0.212 | 0.023 | 466:449 | 272:262 | 220:204 |
| ANGE11 | Intron 7 | 0.541 | 4.48 | 6.97 | 9.08 | 0.026 | 0.008 | 0.002 | 596:620 | 335:359 | 255:279 |
| CLD713 | Intron 12 | 0.046 | 0.24 | 0.01 | 0.06 | 0.662 | 0.922 | 0.814 | 56:58 | 33:33 | 26:27 |
| CLD712 | Intron 11 | 0.854 | 0.88 | 0.07 | 0.25 | 0.392 | 0.775 | 0.649 | 1058:1066 | 624:626 | 490:493 |
| CLD706 | Intron 6 | 0.116 | 0.85 | 0.07 | 0.24 | 0.382 | 0.787 | 0.647 | 117:123 | 75:74 | 55:57 |
| CLD703 | Exon 3-aa24, Val-Ala | 0.277 | 0.18 | 0.01 | 0.01 | 0.721 | 0.92 | 0.912 | 359:354 | 220:221 | 175:174 |
| CLD701 | 5' UTR Promoter | 0.955 | 0.02 | 0.01 | 0 | 0.9 | 0.944 | 0.979 | 1228:1227 | 727:727 | 568:568 |

Statistically significant values in bold
Haplotype defined by SNPs shaded in grey Table 2C cont'd

| Haplotype* | Frequency |
|---|---|
| 1.1.1.1.1.1.1 | 0.219 |
| 2.1.1.1.1.1.1 | 0.011 |
| 1.1.1.1.2.1.1 | 0.275 |
| 2.1.1.1.2.1.1 | 0.01 |
| 1.1.1.1.1.1.2 | 0.017 |
| 2.1.1.1.1.1.2 | 0.049 |
| 1.1.1.1.1.2.2 | 0.011 |
| 2.1.2.1.1.2.2 | 0.022 |
| 2.1.1.2.1.2.2 | 0.064 |
| 2.2.1.2.1.2.2 | 0.028 |
| 2.2.2.2.1.2.2 | 0.241 |

The haplotype 2222122 (shaded) with a frequency of 24%, shows the greatest distortion in all cases

|  | Obs | Exp | Chi Sq | Prob |
|---|---|---|---|---|
| Atopy | 321.96 | 290.97 | 9.88 | 0.0017 |
| Asthma | 193.84 | 171 | 9.2 | 0.0024 |
| Atopy+Asthma | 156.92 | 130.66 | 15.91 | 0 |

Table 3
Full length cDNAs isolated from region

| Name | Position in Contig* | Homology: Function |
|---|---|---|
| CLLD8 | 294727-309803 | Methyl CpG binding domain and a SET domain. Epigenetic modulation of gene expression by histone H3 methylation |
| ANGE (NY-REN-34) | 313649-346509 | PHD zinc finger domains: nuclear protein binding (possibly BRCA1) |
| CLLD7 | 349634-410846 | RLG and RCC1: cell cycle regulation by chromatin remodelling; histone H2A and 2B docking. |
| Emopamil - binding related protein (EBRP) | 467557-498344 | D8-D7 sterol isomerase |
| Karyopherin-∀ 3 (KPNA3) | 506187-598852 | Nuclear transport protein |
| CLLD6 | 721749-734946 | SPRY domain: potential microtubule-binding |

*The position is in base pairs from the beginning of the reference sequence.

Table 4A
SNPs identified in the region

| Base Change | SNP Position | SNP NAME | MARKER (Cross ref to Table 2) |
|---|---|---|---|
| C/G | 3706 | 101063B15.1 | 101063b15_1 |
| A/G | 20722 | 101458B9.1 | |
| A/G | 22872 | 101458B10.1 | 101458b10_1 |
| C/T | 23748 | 101458B10.2 | |
| A/G | 71508 | 101094B11.2 | 101094b11_2 |
| A/C | 71903 | 101094B11.1 | |
| A/G | 78071 | 1011417B14.2 | |
| A/C | 78790 | 1011417B14.1 | |
| A/G | 102686 | CLLD8_X1_A384G | |
| G/T | 102687 | d8ex1 | |
| A/G | 108716 | d8in1a | |
| A/T | 109340 | d8in1b | |
| A/C | 118529 | d8in1c | |
| C/T | 118887 | d8in3b | |
| C/T | 118893 | d8in3c | |
| C/G | 118996 | d8in3d | |
| A/G | 119053 | CLLD8_X4_G28A | |
| G/T | 121758 | d8in4a | |
| C/T | 121801 | d8in4b | |
| A/G | 121925 | d8in4 | |
| A/G | 127665 | d8in6a | |
| A/T | 129915 | d8in6b | |
| A/G | 132497 | d8in6d | |
| A/G | 132820 | d8in6e | |
| A/G | 134465 | d8ex7 | d8ex7 |
| G/T | 138153 | 185316B2.2 | 185316b2_2 |
| C/T | 138191 | 185316B2.1 | 185316b2_1 |
| C/T | 138771 | d8in8 | |
| A/T | 140748 | d8ex101 | |
| A/G | 140942 | d8ex10 | |

Table 4A cont'd
SNPs identified in the region

| Base Change | SNP Position | SNP NAME | MARKER (Cross ref to Table 2) |
|---|---|---|---|
| A/T | 140944 | 8ex101 | |
| C/G | 141131 | 185316B1.2 | 185316b1_2 |
| A/G | 141132 | d8in9 | |
| A/G | 141478 | 185316b1.1 | 185316b1_1 |
| A/G | 142531 | d8in11c | |
| A/G | 142712 | d8in11d | |
| A/C | 143199 | d8in11e | |
| C/T | 143376 | d8in11f | |
| A/G | 144314 | d8in12a | |
| A/T | 145955 | d8in12b | |
| A/G | 146018 | d8in12c | |
| C/T | 146172 | d8in12 | d8in12 |
| A/G | 147356 | d8in13a | |
| A/G | 148684 | d8in13 | d8in13 |
| C/G | 151091 | d8in15b | |
| C/G | 153918 | i154016.1 | |
| C/T | 155126 | 154016_1A.1 | |
| C/G | 157408 | 185306B7.3 | 185306b7_3 |
| A/G | 158149 | angein1a | |
| A/G | 158597 | 185306B7.2 | 185306b7_2 |
| A/C | 158601 | 185306B7.1 | 185306b7_1 |
| G/T | 158996 | angein1b | |
| A/G | 164692 | 154016_2 | 154016_2R |
| C/T | 170985 | angein2 | |
| C/T | 170987 | i154016.2 | |
| C/T | 171079 | ANGE1X3C148T | |
| A/G | 171373 | ANGE1rs2147985 | |
| C/G | 175937 | ANGE1X4C46G | |
| A/G | 175961 | 154016_4 | |
| C/T | 175964 | ANGE1X4C76T | |
| ACTC/- | 175972 | 154016_4 | |

Table 4A cont'd
SNPs identified in the region

| Base Change | SNP Position | SNP NAME | MARKER (Cross ref to Table 2) |
|---|---|---|---|
| C/G | 175974 | i154016.4 | |
| G/T | 178453 | 185752b4.1 | 185752b4_1 |
| A/G | 178972 | 185752B4.2 | 185752b4_2 |
| C/T | 179021 | 154016_5 | |
| A/G | 179288 | 154016in5 | 154016_in5r |
| C/G | 179798 | 185752B4.3 | 185752b4_3 |
| C/G | 179972 | i154016.5 | 154016_5S |
| A/G | 181343 | i154016.6 | |
| C/T | 181824 | angein7 | Angein7 |
| A/T | 182157 | i154016.7 | |
| (TT)/- | 184474 | ANGE1X9_2_base_deletion_from_position_223 | |
| (TTAT)/- | 184486 | ANGE1X9_4_base_deletion_starting_from_position_234 | |
| C/T | 184492 | ANGE1X9C241T | |
| A/G | 184512 | ANGE1G261A | |
| C/T | 184592 | ANGE1X9C341T | |
| C/T | 184595 | ANGE1X9C344T | |
| C/T | 184601 | ANGE1X9T350C | |
| C/G | 184602 | ANGE1X9G351C | |
| C/T | 184627 | ANGE1X9C376T | |
| A/G | 184743 | ANGE1X9A492G | |
| C/T | 184916 | angein9a | |
| A/G | 184937 | angein9b | |
| A/T | 185499 | 185752B5.1 | 185752b5_1 |
| C/T | 186064 | 185752B5.2 | 185752b5_2 |
| A/G | 186655 | 185752B5.3 | 154016_319 |
| C/T | 186835 | angein10 | |
| A/G | 187062 | i154016.9 | |
| TCTTTA/AGATAA/- | 190178 | 6_BASE_INSERTION_STARTING_AT_POS_371 | |
| A/T | 190181 | 44593_6 | |
| A/T | 190246 | d7ex13a | |
| T/- | 190396 | 1_BASE_DELETION_AT_POS_153 | |

Table 4A cont'd
SNPs identified in the region

| Base Change | SNP Position | SNP NAME | MARKER (Cross ref to Table 2) |
|---|---|---|---|
| A/G | 190429 | CLLD7_X13.4_C120T | |
| A/C | 190656 | CLLD7_X13.3_RS1046034 | |
| A/G | 190800 | 185752B6.1 | 185752b6_1 |
| GAAAGATGATAAAGT | 191055 | 44593_15 | 44593_15 |
| G/T | 191122 | d7ex13b | |
| C/T | 191134 | CLLD7X13.2_RS1046028 | |
| C/T | 191168 | d7ex13c. | |
| C/G | 191220 | 185752B6.2 | |
| A/G | 191749 | 185752B6.3 | 185752b6_3 |
| A/T | 191763 | d7ex13e | |
| C/G | 191818 | CLLD7_X13_C499G | |
| C/T | 192097 | 185752B6.4 | 185752b6_4 |
| A/G | 192200 | d7ex13f | |
| A/T | 198826 | d7in12 | |
| C/T | 199514 | CLLD7_RS1536195 | |
| C/G | 199779 | d7ex11 | |
| C/G | 207467 | d7ex9a | |
| A/G | 207470 | d7ex9b | |
| A/G | 207494 | d7ex9c | |
| G/T | 207533 | d7ex9d | |
| A/G | 210227 | CLLD7_X7_RS2274278 | |
| C/T | 210512 | CLLD7_RS_2274281 | |
| C/T | 213444 | d7in6 | |
| A/G | 213460 | CLLD7_X6_RS2274284 | |
| C/T | 217944 | d7ex5a | |
| A/G | 217995 | d7ex5b | |
| C/T | 225121 | d3in3 | |
| A/G | 225190 | d3ex3a | |
| A/G | 225207 | d3ex3b | |
| C/T | 239484 | 432343B33.2 | 432343b33_2 |
| A/G | 240010 | 432343B33.1 | 432343b33_1 |

Table 4A cont'd
SNPs identified in the region

| Base Change | SNP Position | SNP NAME | MARKER (Cross ref to Table 2) |
|---|---|---|---|
| C/T | 241987 | 432343B32.2 | 432343b32_2 |
| A/G | 242784 | 432343B32.1 | 432343b32_1 |
| A/T | 243337 | CLLD7_X1A295T | |
| C/T | 243831 | CLLD7_PROM_1_A351G | |
| A/T | 266607 | 432363B41.1 | |
| A/G | 278239 | i5133822.1 | |
| G/T | 278252 | i5133822.2 | 5133822_2 |
| A/G | 282003 | 4321031B43.1 | 4321031b43_1 |
| A/G | 282243 | 4321031B43.2 | 4321031b43_2 |
| C/T | 283853 | 4321031B44.1 | |
| C/T | 327886 | i1895799.1 | 1895799_1 |
| A/C | 332711 | i1433174.1 | 143317.1 |
| C/T | 349070 | i1895799.2 | |
| A/C | 349073 | i1895799.3 | |
| C/T | 357678 | 4321017B38.4 | |
| C/T | 359360 | 4321017B38.3 | 4321017b38_3 |
| C/G | 359691 | 4321017B38.2 | |
| A/G | 360186 | 4321017B38.1 | 4321017b38_1 |
| A/G | 360524 | i626789.4 | |
| C/T | 379960 | i626789.3 | 626789_3 |
| A/T | 380332 | i626789.2 | |
| C/T | 383520 | 626789.1 | |
| C/T | 383522 | i626789.1 | |
| C/G | 407505 | 1951336b18.1 | |
| A/G | 434774 | 195226B35.1 | 195226b35_1 |
| G/T | 443990 | 195226B34.1 | |
| C/T | 449093 | 1951054B37.1 | 1951054b37_1 |
| C/G | 449664 | 1951054B37.2 | 1951054b37_2 |
| A/G | 478470 | 236969B17.1 | 236969b17_1 |
| G/T | 516429 | 236717B28.1 | 236717b28_1 |
| C/T | 516829 | 236717B28.2 | 236717b28_2 |

Table 4A cont'd
SNPs identified in the region

| Base Change | SNP Position | SNP NAME | MARKER (Cross ref to Table 2) |
|---|---|---|---|
| A/G | 549422 | 236357B29.1 | |
| A/C | 593629 | 236618B30.1 | |
| C/T | 615612 | 2361170B26.2 | 2361170b26_2 |
| C/G | 615975 | 2361170B26.1 | 2361170b26_1 |

Table 4B

| No | Marker | Position | SNP | F primer | R primer | Primer Modified | enzyme |
|---|---|---|---|---|---|---|---|
| 1 | 101660b13_1 | 155075 | A/T | ATGTGGGCTGGAGTTGTG | CAAGTGTGTGACATATC | no | MnlI |
| 2 | 101063b15_1 | 164308 | G/C | GCTCTAATTCCCTATTGC | CTGGAGGAATTCTACCCC | no | AvrII |
| 3 | 101458b10_1 | 182663 | A/G | ACCCAACGTAATCTACAGGTGCA | GTCAAGTCATGTGATTCTTC | yes | BtsI |
| 4 | 101283b16_1 | 183384 | T/C | GCATTCTCCAGGGCTTTG | ACTGCCTGAGGACCAAAC | no | BsaAI |
| 5 | 101283b16_2 | 183563 | C/T | CAGAGGCTGGGAGAGAG | CGTTGGGAGGGAAGTCAG | no | HphI |
| 6 | 101094b11_2 | 231215 | C/T | CCAAGTGTACAGGGAATAG | AATGAAAGTAGAAAAGGGCC | yes | HpaII |
| 7 | 185316b2_2 | 297860 | C/T | GTTATTTGTCACTTGACAAG | ACATTTATCAAGACAGTCTC | no | MseI |
| 8 | 185316b2_1 | 297898 | C/A | GTTATTTGTCACTTGACAAG | ACATTTATCAAGACAGTCTC | no | CacBI |
| 9 | 185316b1_2 | 300838 | G/C | GGTCCCAACTAACTACATTTGC | GCTTACTGTGTAAGTAACAG | no | BsrI |
| 10 | 185316b1_1 | 301185 | T/C | ATCTCTAATAACTGAATGGTA | AACATAGATGTTCTTACTTAG | yes | RsaI |
| 11 | 185306b7_3 | 317115 | G/C | AATAGGAATAAGGATGTGAGT | GAAATCTTCTATCCTGAATTC | yes | HinfI |
| 12 | 185306b7_2 | 318304 | T/C | AAGCGATACTATCTGACAG | AATCTGTACAGTTCCTGAG | no | MseI |
| 13 | 185306b7_1 | 318308 | T/G | TAAATCCCCCATATCGCAG | TGAGAGATGCCTGTCTGTG | yes | BtsI |
| 14 | 185752b4_1 | 338162 | T/G | CACTTCATTCTTCATCATAG | GCAAGCTTAATTAAGGAGA | yes | BsmAI |
| 15 | 185752b4_2 | 338770 | A/G | GTTTAAAGAAAGGTAAACAATT | CAAAGAGAATAGGTCTTGTTC | yes | MfeI |
| 16 | 185752b4_3 | 339509 | C/G | CACCAATTATATTGTTTCC | GGACGATTTGGAAAGTACC | no | NspI |
| 17 | 154016_5S | 339479 | G/C | CCTTTATCATAAGTGCTGC | AAGAGCTTCCCGACTATG | no | HpyCH4III |
| 18 | 185752b5_1 | 345206 | A/T | GAGTGAGTGCCCTCC | GGTTATAAATGTAGTAAAGAA | yes | EcoRI |
| 19 | 185752b5_2 | 345743 | C/T | CTAAGTTCCACAATTAAAAG | GTCCCTTTGTGTATCTTTGAG | no | AluI |
| 20 | 185752b5_3 | 346362 | G/A | GCATCTCAACAAAGGTGGC | CATGACTCTTGGCTTAGGAGA | yes | BsmAI |
| 21 | 154016_319 | 346363 | G/A | TGACTCTTGGCTTAGGACA | CATGTCAACAAAGGTGGC | yes | NlaIII |
| 22 | 185752b6_1 | 350507 | A/G | CCCACTGTAATTTGGCTC | AAGACAGTAGTTTATTTGAAC | no | SplI |
| 23 | 44593_15 | 350770 | 15bp del | GGAACACCATAATTTTGGTG | TCTTCAAGTCAACCCTCTTA | no | - |
| 24 | 185752b6_3 | 351465 | A/G | CAACTTTTCACGGATACTTC | TACGGCTTTTCTTGAGCC | no | BsaAI |
| 25 | 186752b6_4 | 351804 | T/C | CCCTTTACATGTTCCAGC | TTTTGTTGTGTCCAGGAT | no | MnlI |
| 26 | 432343b33_2 | 399283 | A/G | CTCAAGTCCCAGATCTC | CAGGTACCTGTGGGATATTAAA | no | AciI |
| 27 | 432343b33_1 | 399823 | T/C | ACTTCTGCTTCAGATCCC | ATAGTAATCACAGAATGGGAT | yes | FokI |
| 28 | 432343b32_2 | 401649 | A/G | CAAAGCTGTGTCAAGCTTGTAG | GAAGGATATCATCATGA | yes | PshAI |
| 29 | 43234332_1 | 402491 | T/C | GGCAGGGATTTTGTTAGTG | AGTGTCTTACATGCAAATACAT | yes | NlaIII |

Table 4B cont'd

| # | ID | Position | Allele | Sequence 1 | Sequence 2 | Cut | Enzyme |
|---|---|---|---|---|---|---|---|
| 30 | 5133822_2 | 427516 | G/T | TATGTAGGAATAAGGCAATG | AGTTTCTTCAACAACCTGC | yes | PstI |
| 31 | 4321031b43_1 | 430907 | G/A | TGATCCTCAACACAGCTC | ACATTTTTCCAGAGATATTGTA | yes | RsaI |
| 32 | 4321031b43_2 | 433147 | A/G | CTCAAGTCCCAGATCTC | CAGGTACCTGTGGGATATTAAA | no | AclI |
| 33 | 1895799_1 | 476787 | C/T | GAGGCGTTTGACAGTCAC | TTAGGGTGAGACATACCC | no | BanI |
| 34 | 143317_1 | 481792 | C/A | CAGAGAAAGACATGGGAG | CTACTGTTTGTGCCACAG | no | BbcVI |
| 35 | 4321017b38_3 | 508259 | G/A | GGAAGACTAAAGAGCTGC | TTTATTCAATAACCAAGTTTC | yes | PstI |
| 36 | 4321010b38_1 | 509085 | T/C | CTTCATTATAAGGTAAAGCTG | TAACACGTTTCGAAACTGC | yes | Fnu4H |
| 37 | 195226b35_1 | 583672 | T/C | GCTTTTTTGTCTTTTAGATCA | GTACACAAATTAAGTTATACAAG | yes | NlaIII |
| 38 | 1951054b37_1 | 597991 | C/T | GTAAACAATGAAACAAAACC | GCAGCGCTAGAGGTCTC | no | MboII |
| 39 | 1951054b37_2 | 598562 | C/G | GCAACTAACTGAGTGACC | TCCGACCTCCGCTCCTA | yes | AvrII |
| 40 | 236969B17_1 | 627368 | C/T | CACATCTCATAATGGTATCAC | GAAGAAGGGTATGCTTTAGA | yes | MboII |
| 41 | 236717b28_1 | 665326 | T/G | TTCTTGGTAAACATCTCTAC | CCTGAACAGGCTGTACTC | no | EcoRI |
| 42 | 236717b28_2 | 665725 | T/C | GATAGGAAAGATTTTGGTCT | CCGTTCTTAGTTTGGGTC | yes | BsmAI |
| 43 | 2361170b26_2 | 764495 | A/G | CTGGGCTACCTGTGGATCACT | CTGTTTACAGTAGACATTCC | yes | BsaBI |
| 44 | 2361170b26_1 | 764858 | C/G | CTAGGCAGGCACTC | GGCACCTCACGTGGATG | no | ApaI |
| 45 | 626789_3 | 128859 | | TCAACCTGCAATGAAATC | GTTGACTCTCTCTTCTTGCC | | |
| 46 | 154016_9R | 346769 | | ATTCTACTTACAGCCCATG | GTCCAATTTAAAATTAGGCG | | |
| 47 | 5133822_1 | 27143 | | TAAGTGCAGCGAACCCAG | CACTTGGCTGCCTGGAC | | |
| 48 | 626789_4 | 109423 | | ACTTACATCATCACCAGAG | ATTTCTCCATGATTAAAATCAG | | |
| 49 | 626789_1 | 123421 | | ACATCTTTTAGACACATAAC | TTGGCTAGCAGGCAATTG | | |
| 50 | 626789_2 | 129231 | | TCCTCACCATTAGTCAAAG | TTAATGGTATGATAGCAACC | | |
| 51 | 1895799_2 | 97969 | | GTTTTGGTGGAGGAATCGG | GTTTCTCCCTGCTTTC | | |
| 52 | 1895799_3 | 97972 | | GTTGGTGGAGGAATCGG | GTTTCTCTCCTGCTTC | | |
| 53 | 154016_1S | 313625 | | GACTAGACTGGAATCTGG | CGGTACACACCGGTGG | | |
| 54 | 154016_4S | 335681 | | ATTCCCAAATGAGAGCAGCC | CATAACCCCTGTGCATCC | | |
| 55 | 154016_4R | 335560 | | ATTCCCAAATGAGAGCAGCC | CATAACCCCTGTGCATCC | | |
| 56 | 154016_4R2 | 335668 | | ATTCCCAAATGAGAGCAGCC | CATAACCCCTGTGCATCC | | |
| 57 | 154016_4ins | 335679 | | ATTCCCAAATGAGAGCAGCC | CATAACCCCTGTGCATCC | | |
| 58 | 154016_5Y | 338728 | | GACATCTAACTGAGTCTCC | TAGTCAGTCATATCACATAG | | |
| 59 | 154016_1A.1Y | 314833 | | CACAAAGGCACCAAACCAC | ACCCTTACAGTCCATATGTA | | |
| 60 | 154016_1A.2Y | 314849 | | CACAAAGGCACCAAACCAC | ACCCTTACAGTCCATATGTA | | |

Table 4C

| Gene name | SNP name | SNP alias | 5' Flanking Sequence | SNP (IUB code) | 3' Flanking Sequence | Exonic - amino acid change |
|---|---|---|---|---|---|---|
| CLLD8 | CLLD8 X4 G28A | CLD802 | TCTAATGCAGATAGTCCTATTAACCTCTCAGAGGAATAGTGAAGATTAAATGAGATAAAATATGTAAATTGTTTAGCACAGTAGCTGGCACCATAAATAAAGGTAATGGT | R | ATGCTGTTTTCTGTCTTAACAGAATACATCCAAGCAATGATTCTAGTGAATGAAGCAACTATAATTAACAGTTCAACATCAATAAAGGGTATGTACATCTCTATTCC | |
| CLLD8 | CLLD8 X8 G91A | CLD803 | CTATTTAGGGAAAAAGCTGATAGTGTTCATGAGCCAAACTATTCTAAATGCTATTACATCTTTTATTACATCATTTACACATTATCAAGACAGTCTCTTGACTT | R | ACTTGCTGCTTTTCATTCTTTCTCCATCCATTGCCTGCCTTTTAGAACAAAATGTGCATGTCTTCAACTGACAGCAAGGAATGCCAAAACTTCCCCCTTGTCAAGTGACAAAAT | |
| CLLD8 | CLLD8 X14 G40A | CLD807 | TTATAGGGATTTGTCCCATTTTTGCATTTCTGCCAGCAACATAGAAGAGCGTCAGAACAGGGCGTTTCTGAATGGGTTCCCACTATTAACAGGAGCTGTGATAATTTATACATT | R | ACAAAAAAGAACAAAATCAGTGTGATATATTAAAAACAGAATGGTTTTCTAATGCAAAAGCACAAGGCATCAGACTTTATGCTATTTCTAACCTTTGTGTTTATTTTATTTAACAGCATA | |

Table 4C cont'd

| CLLD8 | CLLD8 X8 G129T | ATGAGCCAAACTATTCTAAATGCTATTACACATCTTTTATTACATCATTTACACATTTATCAAGACAGTCTCTTGACTTGACTTGCTTTTCATTCTTCTCCATCATTGCCT | K | CCTTTTAGAACAAAATGTGCATGTCTTCAACTGACAGCAAGGAATGCCAAAACTTCCCCCTTGTCAAGTGACAAAATAACCACTGGATATAAAATATAAAAGACTACAGAGACA |
| --- | --- | --- | --- | --- |
| CLLD8 | CLLD8 X10 G321A | AAAGAGGAAATTAGAAGTTGCATGTTCAGATTGTGAAGTTGAAGTTCTCCCATTAGGATGGAAAACACATCCTAGAACTGCTAAAACTGAGAAATGTCCACCAAGTTCAGTAATAATCCCAAGGAGCTTACT | R | TGTAAGTAACAGCTGAGGAACCAGAGTAAATCTAAATTATTATCAATCAATTGGTTCTTTTTCATTCCTCCCCTCTTCTTTTCTCCTCATTGTATTTATCATTTGCTTCAAA |
| CLLD8 | CLLD8 X1 A384G | AACGCGCGCGGAGCCCTCGGCCGCCGAGCAGGGGCTGGACCCCAGCCCTTGCAGCTCCTCCTTCTCCTGCACCCAAGTGCAGTCCTGGCTGCAGAAGGGGCCGGGCCACTGAGTTTCCAACCTCC | R | TTTCAGCCTGCTGTCTGTCTCAGGGTGCAGCCTTAATGAGAGGTGATTCCTAAGCTGCTGGGAACCTGAGGTTGTCAAAGGGGCGGCAGGAAATGGACAGCAGTATAAAACCCAGAAGCAGAAC |

Table 4C cont'd

| | | | | |
|---|---|---|---|---|
| CLLD8 | CLLD8 X11 A180G | GTAATAATGGATATATCTGTACTTGAGTAAAGAGAATGAAGAGAATTTTTAGTGATACAGAATAACTTTTTTCCTTTTTAGGGAAACGAAATATGATAATATTTCAAGAATTCA | | TATCATTCAGTTATTAGAGATCCTGAATCCAAGACAGCCATTTTTCAACACAATGGGAAAAAATGGTAAAAAATGCAAAATGTAGTTGGGACCCTTCTTTTCTTTTTTAA |
| ANGE1 | ANGE1X2rs2031532 | ANGE01 | TCTCACCAGGGATATTACTTATAGGTGTCTTTCAGGTTGCAGAAAAGATGGGAAAAAAGGACATGTGCACTCTGCCCCAAAGATGTCGAATATAATGTCCT | R | TACTTTGCACACAATCAGAGAATATAGCTGTCTCATGAGAATTGTTTGGTAAGTTACTTGAAAACATACTTCAAAGTACATGAGTACTTTTAGTGTAGGACAC |
| ANGE1 | ANGE1X3rs2247119 | ANGE02 | ATGGTCTGCTCATCCACCCCCAAAGTTGCCACTGTTTACCCCCAGTCCATTCCCACTCCTGGTTTGATTTTCCACTTTGGTATGATTTTCTGACATG | Y | AGCTTTCAATAATTACTTTGTGCATACTCTGGATTTTTTTTCCAATCTGCAGCTGTATTCTTCAGGACTTGTGGAATGTGAGGATCAGGATCCCACTTAAT |

Table 4C cont'd

| ANGE1 | ANGE1X4 4 base deletion from position 82-85 | ANGE08 | GATAAAATGCAGGGCTTCTGGAACTTAAATAACATTTAATG ATATCTTTGAATTTTAACAAATAACAACAAACAGGTACT | (ACTC) | AGTAAAATCTATTCTTCTGTAGAAATGCAAATTTGT CATAAAGAGGAGCCACCGTGGGATGTGATTAAA AACTGTAACAAGAATTACCACTTTTCTGTGCCAA GAAGGACGACGCAGTTCCACAGTCTGATGGAGTC GAGGAATTTATAAGTATTTAATAAAACATTTTAAAA CCACATTTGGGGGATTGGGATAAGG | |
|---|---|---|---|---|---|---|
| ANGE1 | ANGE1rs942870 | ANGE11 | AAGAACTTATCCATGTAACCTGAAACCACCTGTTCCCCAAA AGGTATTGAAATTTAAAAGTTACAGTTTTATATGTTTAAAA AAGCCCTCTTAATTCATA | Y | AGTTATTGTAAGCAGAGAAATTTCATTTTTACTTTT TGTAACATTTTATTCATTGTTTCAGCTGGCCAAAAAA AATGAGGTATGATGATGAAATTATAATA | |
| ANGE1 | ANGE1X3C148T | | CTGACATGTAGCTTTCAATATTACTTTGTGCATACTCTGGA TTTTTTTCCAATCTGCAGCTGTATTCTTCAGGACTTGTG GAATGTGAGGATCAGGAT | Y | CACTTAATCCTGATAGAAGTTTGATGTGGAATCAG TAAAGAAAGAAATCCAGAGAGGAAGGAAGTTGGTA AGTGTAAATGATGTTATTCTTATACTGG | P46S |

Table 4C cont'd

| ANGE1 | ANGE1rs2147985 | AACTGTATTGGAAACCTCAATTCAACTTAACATTTAATTTTT TTTTTTTTTTGAGACGGAGTTTGCTCTTGTTGCCCA GGCTAGAGTGCAGTGAC | R | CGGTCTCAGCTCACTGCAACCTCCGCCTCCTGGGT TCAAGCGATTCTCTGCCTCAGCCTCCCGAGTAGC TAGGATTACAGGCACGGGCCACCATGCTCG |
| --- | --- | --- | --- | --- |
| ANGE1 | ANGE1X4C46G | CAAATATAAGTACTGTACCCTAATGTTTGTAACGGGATGGA ATCTTGCTGATGATGCCCAGGATGCCGGCTTCTG GAACTTAAATAACATTTAATGATAT | S | ATGGAAAAAGGACATGTGCACTCTGCCCCAAAGA TGTCGAATATAATGTCCTGCTACTTTGCACAATCAGA GAATAGCTGCTCATGAGAATGTTTGCTGTATTC TTCAGGACTTGTGGAATGTGAGGATCAGGAT |
| ANGE1 | ANGE1X4C76T | TACCCTAATGTTTGTAACGGGATGGAATCTTGCTGATGAT GCCCAGGATAAATGCAGGCTTCTGGAACTTAAATAACA TTTAATGATATCTTTGAATTTTAACAAATAACAACAA | Y | ATGGAAAAAGGACATGTGCACTCTGCCCCAAAGA TGTCGAATATAATGTCCTGCTACTTTGCACAATCAGA GAATAGCTGCTCATGAGAATGTTTGCTGTATTC TTCAGGACTTGTGGAATGTGAGGATCAGGAT |

Table 4C cont'd

| | | | |
|---|---|---|---|
| ANGE1 | ANGE1X4C81T | GATAAAATGCAGGGCTTCTGGAACTTAAATAACATTTAATG ATATCTTTGAATTTTAACAAATAACAACAAACAGGTACT | Y | ACTCAGTAAAATCTATTCTTCTGTAGAAATGCAAATT TTGTCATAAAGAGGAGCCACCGTGGGATGTGATT TAAAAACTGTAACAAGAATTACCACTTTTCTGTGC CAAGAAGGACGACGCAGTTCCACAGTCTGATGGAG TTCGAGGAATTTATAAGTATTTAATAAAACATTTTTA AAACCACATTTGGGGGATTGGGGATAAGG |
| ANGE1 | ANGE1rs2274276 | ATTGAGTGCATTCCCATATCTTTTCACCAATTATATTGTTT TCCTATGACCCAATTTGTTCATTTTTCTATTCAATGAACCCT CTCCCCAGAGAGTTCC | S | CATGTGCCAATTTTTCTACTCAATTATTTACCTGTTT TGCATTAAACTTATAATATCTTTTTAAAAATTAACCC TTTATCATAAGTGCTGCAAACACTT |
| ANGE1 | ANGE1X6rs2274277 | CCTTTATCATAAGTGCTGCAAACACTTAGTTGAAGTTTGCC ATATCTTTTGACTTTGTAAAAACTTTTGGCATATGAGTTGTA TATTTCATGTAGTCAAA | S | AGTAATCTTTTCCTTTATGGATTCCAATTTTTAAATG GTTTATATTTTAGCTAAATTTCAGGAGTGAAAAGA AAAGAGGAAGGAAGAAACCCCTCTC |

Table 4C cont'd

| | | | |
|---|---|---|---|
| ANGE1 | ANGE1X9 2 base deletion from position 223 | GTTCCATGGCACATGACTGCTCTCTTCCTTTCCCCTGTTT TGGATTACATATATGAAATGGAGGAGTTCTGCCTATACAAA CTGTTTAATATTGAAAATGTTCTCTCCCTCCAGACTATGA AGAAATCGGGAGTGCACTTTTTGACTGTAGATTGTTCGAA GACACATTTGTAAATTTTCAAGCAGGTATGAGTTATATA ACATCTGAGCAGCATAGT | (TT) | TTGAGAAATATTTATCACGATATTGAAACAATATACT GTACAGGTGATAAAATATTTAGAAGAAGTGTTCATT GTTTTCTTAAATGAGAAAGCCAATTACAAAAACAGT ATGACCCCGCCCACCTGCCCACACACAGGAAAA AAATATCGAGGTACATGTGCACAGACAAAAGCTGCA CCTGGTGGAGACAGTAGTTGGTTGTAGGTAGTGG AATATAGTGATTTTTGTCTGTCTTTACTGCTATAT TTTCCAGATTTTCTATATACACAAATAGTAGAGACAACAAA ATGAGAAAAACTCATTAAAAAGTAGAGACAACAACAAA AAATTGATTCAAAATTGGAGCATATTTTGGCCTGT GTGTGGCCCAGGCAGGAGCTGGTAAAGCTTC |
| ANGE1 | ANGE1X9 4 base deletion starting from position 234 | GTGCACTTTTTGACTGTAGATTGTTCGAAGACACATTGTA AATTTTCAAGCAGGTATATGAGTTATATAACATCTGAGCAG CATAGTTTTGAGAAATAT | (TTAT) | CACGATATTGAAACAATATACTGTACAGGTGATAAA AATATTTAGAAGAATGTTCATTGTTTTCTTAAATGA GAAAAGCCAATTACAAAAACAG |
| ANGE1 | ANGE1X9C241T | GTTCCATGGCACATGACTGCTCTCTTCCTTTCCCCTGTTT TGGATTACATATATGAAATGGAGGAGTTCTGCCTATACAAA CTGTTTAATATTGAAAATGTTCTCTCCCTCCAGACTATGA AGAAATCGGGAGTGCACTTTTTGACTGTAGATTGTTCGAA GACACATTTGTAAATTTTCAAGCAGCAGTATGAGTTATATA ACATCTGAGCAGCAGCATAGTTTTGAGAAATATTTATCA | Y | GATATTGAAACAATATACTGTACAGGTGATAAAAATA TTTTAGAAGAATGTTCATTGTTTCTTAAATGAGAAA AGCCAATTACAAAAACAGTATGACCCCGCCCACCTG CCCACACACAGGAAAAAATATCGAGGTACATGT GCACAGACAAAGCTGCACCTGGTGGAGACAGTAG TTGGTTGTAGGTAGTTGGAATATAGTGATTTTGTC TGTTCTTTACTGCTATATTTCCAGATTTCTAT ACACACAAATACTTTTATAATGAGAAAAACTCATTAA AAAAGTAGAGACAACAAAAATTGATTCAAAATTG GAGCATATTTTGGCCTGTGTGGCCCAGGCAGGA GCTGGTAAAGCTTC |

Table 4C cont'd

| ANGE1 | ANGE1G261A | | GTTCCATGGCACATGACTGCTCTCTTTCCTTTCCCCTGTTT<br>TGGATTACATATATAAATGGAGGAGTTTCTGCCTATACAAA<br>CTGTTTAATATTGAAAATGTTTCTCCCTCCAGACTATGA<br>AGAAATCGGGAGTGCACTTTTTGACTGTAGATTGTTCGAA<br>GACACATTGTAAATTTCAAGCAGTATATGAGTTATATA<br>ACATCTGAGCAGCAGTAGTTTGAGAAATATTTATCACGATA<br>TTGAAACAATATACT | R | TACAGGTGATAAAAATATTTAGAAGAATGTTCATTG<br>TTTTCTTAAATGAGAAAGCCAATTACAAAAACAGTA<br>TGACCCCGCCCACCTGCCCACACACACAGGAAAAA<br>AATATCGAGGTACATGTGCACAGACAAAAGCTGCA<br>CCTGGTGGAGACAGTAGTTGGTTGTGTAGGTAGTGG<br>AATATAGTGATTTTTGTCTGTTCTTTACTGCTATAT<br>TTTCCAGATTTCTATATACACACAAATACTTTTATA<br>ATGAGAAAACTCATTAAAAAGTAGAGACAACAAA<br>AAATTGATTCAAAATTGGAGCATATTTTGGCCTGT<br>GTGTGGCCCAGGCAGGAGCTGGTAAAGCTTC |
| ANGE1 | ANGE1X9C341T | | GTTCCATGGCACATGACTGCTCTCTTTCCTTTCCCCTGTTT<br>TGGATTACATATATAAATGGAGGAGTTTCTGCCTATACAAA<br>CTGTTTAATATTGAAAATGTTTCTCCCTCCAGACTGTTCGAA<br>AGAAATCGGGAGTGCACTTTTTGACTGTAGATTGTTCGAA<br>GACACATTGTAAATTTCAAGCAGTATATGAGTTATATA<br>ACATCTGAGCAGCAGTAGTTTGAGAAATATTTATCACGATA<br>TTGAAACAATATACTGTTGTTTCTTAAATGAGAAAAGCCAATTACAA<br>AAACAGTATGACC | Y | CGCCACCTGCCCACACACAGAGACAAAAGCTGCACCTGGT<br>GGAGACAGTAGTTGGTTGTAGGTAGTTGGAATATA<br>GTGATTTTGTCTGTTCTTTACTGCTATATTTTCCA<br>GATTTCTATATACACACAAATACTTTTATAATGAGA<br>AAACTCATTAAAAAGTAGAGACAACAAAAAATTGA<br>TTCAAAAATTGGAGCATATTTTGGCCTGTGTGTGGC<br>CCAGGCAGGAGCTGGTAAAGCTTC |
| ANGE1 | ANGE1X9C344T | | GTTCCATGGCACATGACTGCTCTCTTTCCTTTCCCCTGTTT<br>TGGATTACATATATAAATGGAGGAGTTTCTGCCTATACAAA<br>CTGTTTAATATTGAAAATGTTTCTCCCTCCAGACTATGA<br>AGAAATCGGGAGTGCACTTTTTGACTGTAGATTGTTCGAA<br>GACACATTGTAAATTTCAAGCAGTATATGAGTTATATA<br>ACATCTGAGCAGCAGTAGTTTGAGAAATATTTATCACGATA<br>TTGAAACAATATACTGTTGTTTCTTAAATGAGAAAAGCCAATTACAA<br>GAATGTTCATTGTTTTCTTAAATGAGAAAAGCCAATTACAA<br>AAACAGTATGACCCCCG | Y | CCAACTGCCCACACACAGGAAAAAATATCGAG<br>GTACATGTGCACAGACAAAAGCTGCACCTGGTGGA<br>GACAGTAGTTGGTTGTAGGTAGTTGGAATATAGTGA<br>TTTTTGTCTGTTCTTTACTGCTATATTTTCCAGATT<br>TCTATATACACACAAATACTTTTATAATGAGAAAA<br>CTCATTAAAAAGTAGAGACAACAAAAATTGATTCA<br>AAAATTGGAGCATATTTTGGCCTGTGTGTGGCCCA<br>GGCAGGAGCTGGTAAAGCTTC |

Table 4C cont'd

| ANGE1 | ANGE1X9T350C | GTTCCATGGCACATGACTGCTCTCTTTCCCTTCCCCTGTTT TGGATTACATATATAAATGGAGGAGTTTCTGCCTATACAAA CTGTTTAATATTGAAAATGTTCTCTCCCTCCAGACTATGA AGAAATCGGGAGTGCACTTTTGACTGTAGATGTTCGAA GACACATTTGTAAATTTCAAGCAGCATAGTTTGAGAAAATATTTAGAA ACATCTGAGCAGCATAGTGTACAGGTGATAAAATATTTTAGAA TTGAAACAATATACTGTACAGGTGATAAAATATTTTAGAA GAATGTTCATTGTTTCTTAAATGAGAAAAGCCAATTACAA AAACAGTATGACCCCGCCCACC | Y | GCCCACACACAGGAAAAATATCGAGGTACAT GTGCACAGACAAAAGCTGCACCTGGTGGAGACAGT AGTTGGTTGTAGGTAGTTGGAATAGTAGTGATTTTG TCTGTTCTTTACTGCTATATTTCCAGATTTTCTAT ATACACACAAATACTTTATATGAGAAAAACTCATT AAAAAAGTAGAGACAACAAAAAATTGATTCAAAAAT GGAGCATATTTGGCCTGTGTGTGGCCCAGGCAGG AGCTGGTAAAGCTTC |
| ANGE1 | ANGE1X9G351C | GTTCCATGGCACATGACTGCTCTCTTTCCCTTCCCCTGTTT TGGATTACATATATAAATGGAGGAGTTTCTGCCTATACAAA CTGTTTAATATTGAAAATGTTCTCTCCCTCCAGACTATGA AGAAATCGGGAGTGCACTTTTGACTGTAGATGTTCGAA GACACATTTGTAAATTTCAAGCAGCATAGTTTGAGAAAATATTCTAT ACATCTGAGCAGCAATATACTGTACAGGTGATAAAATATTTTAGAA TTGAAACAATATACTGTACAGGTGATAAAATATTTTAGAA GAATGTTCATTGTTTCTTAAATGAGAAAAGCCAATTACA AAACAGTATGACCCCGCCCACCT | S | CCCACACACAGGAAAAAATATCGAGGTACATGT GCACAGACAAAAGCTGCACCTGGTGGAGACAGTAG TTGGTTGTAGGTAGTTGGAATAGTAGTGATTTTGTC TGTTCTTTACTGCTATATTTCCAGATTTTCTATAT ACACACAAATACTTTATATGAGAAAAACTCATTAA AAAAGTAGAGACAACAAAAAATTGATTCAAAAATG GAGCATATTTGGCCTGTGTGTGCCCAGGCAGGA GCTGGTAAAGCTTC |
| ANGE1 | ANGE1X9C376T | GTTCCATGGCACATGACTGCTCTCTTTCCCTTCCCCTGTTT TGGATTACATATATAAATGGAGGAGTTTCTGCCTATACAAA CTGTTTAATATTGAAAATGTTCTCTCCCTCCAGACTATGA AGAAATCGGGAGTGCACTTTTGACTGTAGATGTTCGAA GACACATTTGTAAATTTCAAGCAGCATAGTTTGAGTTATATA ACATCTGAGCAGCATAGTTTGAGAAATATTTATCACGATA TTGAAACAATATACTGTACAGGTGATAAAGAAAATATTTAGAA GAATGTTCATTGTTTCTTAAATGAGAAAAGCCAATTACAA AAACAGTATGACCCCGCCCACCTGCCCACACAGGAA AAATAT | Y | GAGGTACATGTGCACAGACAAAAGCTGCACCTGGT GGAGACAGTAGTTGGTTGTAGGTAGTTGGAATATA GTGATTTTGTCTGTTCTTTACTGCTATATTTCCA GATTTCTATATACACACAAATACTTTATATGAGA AAACTCATTAAAAAAGTAGAGACAACAAAAAATTGA TTCAAAAATTGGAGCATATTTGGCCTGTGTGTGGC CCAGGCAGGAGCTGGTAAAGCTTC |

Table 4C cont'd

| | | | | |
|---|---|---|---|---|
| ANGE1 | ANGE1X9A492G | | GTTCCATGGCACATGACTGCTCTCTTCCTTCCCCTGTT<br>TGGATTACATATATAAATGGAGGAGTTTCTGCCTATACAAA<br>CTGTTTAATATTGAAATGTTTCTCCCTCCAGACTATGA<br>AGAAATCGGGAGTGCACTTTTTGACTGTAGATTGTTCGAA<br>GACACATTTGTAAATTTCAAGCAGGTATATGAGTTATATA<br>ACATCTGAGCAGCATAGTTTTGAGAAATATTTATCACGATA<br>TTGAAACAATATACTGTACAGGTGATAAAAATATTTTAGAA<br>GAATGTTCATTGTTTTCTTAAATGAGAAAAGCCAATTACAA<br>AAACAGTATGACCCCGCCACCTGCCCACACACACAGGAA<br>AAAAATATCGAGGTACATGTGGTTAGGTAGTTGGAATATAG<br>TGGTGGAGACAGTAGTTGGTTGTCTTTTACTGCTATATTTTCCAGATTTT<br>CT | R | TATACACACAAATACTTTATAATGAGAAAAACTCAT<br>TAAAAAAGTAGAGACAACAAAAAAATTGATTCAAAAAT<br>TGGAGCATATTTTGGCCTGTGTGTGGGCCAGGCAG<br>GAGCTGGTAAAGCTTC |
| ANGE1 | ANGE1X10G247A | | GAGGCACGAGGATTGTGTATCTGTACCTGCAAGTGAAAGG<br>GGCTAGAAATGGTACATTATTTCTAATAAAACTACTGAATA<br>AGCTGAAATAATAATTTATTTCTTCATAGCAATAGAGAA<br>AAAATTCATGCATCTCAACAAAGGTGGCAGCAGTTGAAG<br>GAAGAGATTGAGCTACTTCAGGACTTAAAACAAACCTGT<br>GCTCTTTTCAAGAAAATAGAGATCTTATGTCAAGTTCTACA<br>TCAATATCATCCCTGTCTTATTAGGGATTACC | R | TTTCCTAAGCCAAGAGTCATGTCAAATTGCAATCAG<br>GCTCAAAACCAGAGAGACCAGGCTGTGAAATCCACAC<br>ATCTTAGAACTAGTCGTCTCCTCTTGGCCTCAGCA<br>GCTCTTCCCTGTCTTCTTACTGGTTGACATTTGATCA<br>CTCTTTGCACACTCTTGTGTTTTTGCTCACTGTCA<br>CATTCCCAGCACCTAGTATGCTCAGTAAATGTTGT<br>GGAATAAGTGCATAAAATGTTCTTAACCTTGATTCT<br>ACTTACAGCCCATGATAGCCTCTTAGATATAATAAAT<br>TGGATTATACTACTTTACTTGTACCAAATTTGCCTG<br>TTTTCGTGTCACAAGTCGTCTTTTGAAAAGTCTCTT<br>TTCAGCCACAGTTATCACGTGA |
| CLLD7 | CLLD7 PROM 1 A351G | CLD01 | AGTGGGCAGGGAGCCAAGTTTCTCGGTCGCTTTCCGTC<br>CTAGGTCTCTGGGGTGGGTAGGCCGACCCTCCCCACAGCC<br>AAGCCATCTCGGGAGCAGAGC | R | GGAGCCCGTGCCTCGCCGCTTCCTGCGTTCCTCAGA<br>CACAAAAGCCTCTAAGTCCCGGCAGCAGCCACCGG<br>ATTTCATGGGACACTCCAGTGGCAGGGCC |

Table 4C cont'd

| | | | | | |
|---|---|---|---|---|---|
| CLLD7 | CLLD7 X3 C247T | TATTTATAGGAATTGCTTGAAGCCAGAGTCATGGTGGATGTCGGAAAGTGGCCCATCTTCACTCTACTCTCCCCTCAAGAGATCGCGTCTATTCGGAAGG | CLD703 | Y | GTGTGTCTTCGGCACCTCAGCCAGTGAAGCACTGTACGTTACTGACAATGATGAGGTAAGAGAGTCTCTTGAAACCTAGTTCGTTTTAGGACTTATTGGC | V24A |
| CLLD7 | CLLD7 RS2274283 | CATTGCCTGTGTCAGACTTCATCCATGGCTGTTCTGGACAATGGCGAGGTGAGGTGTCTCCACTCCCCATTTCCCTTCTACCTTCTTTTTCAATTACAC | CLD706 | R | TCAGTTCTTCACAAGGTGAATGTATCAGATGGAAGAAGGAAGAGTGCTTTGTTTGGTAGCTCCATTGAAAGTTAACTGATTACTGACTGAGGAGCTGG | |
| CLLD7 | CLLD7 RS1536195 | ATATATCCCCTCATATTCTTAGTCCTGAAATGTAAAAAGCTTCAGGTGTATTGGCTTAATTTGGTGCTTAAAAAGATTTGAAGTAAGTATCTTTAAAA | CLD712 | R | TAGTATTGTGTAGTTATTATGGTTAATAGTTTTGGACCTAGTTTATGACCATAGGCTTTTTTGTTCTAATGTTACTGAAGGACTTTTTTTTTAATT | |

Table 4C cont'd

| CLLD7 | CLLD7 RS2296502 | CLD713 | TATCAAGAGAGGAATTACTGTGGAGAATGCCTTTCGCTATTCTCTGCTGCAGTCAGATATGCAGAGATAACTTAAACAACAAACAGAAACCAGACC | | CCTTTAACTCCCTTTGTGTCTGCTGTCTCCCCGCTTCTTGCGTGAGGCATGAAACGATGAGTCACTCCACTTCTGTTTAGGGAATCAGTGAACCCATTGA |
|---|---|---|---|---|---|
| CLLD7 | CLLD7 X1A295T | | GCTGACCTCGCAGGTAGCGTGTGGGCGCGGGGTCGAGCTCGCGGAGGCCTCTTCCCCTCGGCCCCTGCCCTGCTTCCCTTCCCCGCAGGCCCGGGGCCGGG | W | GTGCCCCGTTACTCCTGTACCTCCCGCCTCCCTCGCTCGGGCTCCCGGGGCAGTCCCTGCGGGGCTGCGTCCGGGGCGAGGGATGGGGTCCCCGGCCGG |
| CLLD7 | CLLD7 X5 T206C | | GCTGATTTTTTGTGTGCTTTGTGTGCACAGATGGAGTGGTTTATGCCTGGGGCCACAATGGATATAGCCAGCTTGGGAATGGGACGACCAACCAAGGCAT | Y | GCTCCCGTCCAGGTCTGTACCAATCTCTTGATCAAGCAAGTGGTGGAAGTAGCTTGTGGCTCACATCATTCAATGGCTCTGGCAGCTGATGGAGAGGTAA |

Table 4C cont'd

| | | | | |
|---|---|---|---|---|
| CLLD7 | CLLD7 X6 RS2274284 | TTAAGAGGGTAGTTGGCAATTGCCTGTGTCAGACTTCATC CATGGCTGTTCTGGACAATGGCGAGGTGAGGTGTCTCCA CTCCCATTCCCCTTTCTACCT | Y | CTTTTTCAATTACACGTCAGTTTCTTCACAAGGTGAA TGTATCAGATGGAAGAAGGAAGAGTGCTTTGTTTG GTAGCTCCATTGAAAGTTAACTGATTA |
| CLLD7 | CLLD7 RS 2274281 | TCTATTTCGCCTGTTAAACTGTGACCAAAACTAGTACCTT TCAGAGTGTTCTGACATACAGTAGGTACTAATAATTGTTA GTGAGGCTCAACTTCCTC | R | TGTATTAAACAGGAAAGAGTGACTTGCCCCAGACTA TCTAACTAGTAAGTCATGGAGTAGAAACTGATGCCA ATTCTGTCATCCCCTTCTCCAAAATAGC |
| CLLD7 | CLLD7 X7 RS2274278 | TGTCTCTTCCTTCTTACCAGCAGTTTAAAAATCTCACTCTC TCCCTTCTGTCCTCTCTAAGGTATATGGGTGGGGTTACAA TGGCAACGGTCAGCTGGGC | Y | TGGGAAACAATGCAACCAGCTGACCCCTGTGAGA GTGGCAGCTTTGCACAGCGTGTGTGTGAACCAGGT ACGTGTGGTGCACTCTCAGTTAGTGGCTTCC |

Table 4C cont'd

| CLLD7 | CLLD7 X9 C219A | | TCAGGGTGGTAGAGATTGCAGCCTGTCACTCTGCCACAC GTCTGCAGCCAAGACGCAGGGTGGGCACGTGTACATGTG GGGCCAGTGCCGGGGTCAGTC | | GTGATCCTCCCGCACCTCACCCACTTCTCCTGCAC CGACGACGTGTTTGCCTGCTTTGCCACTCCCGCCG TCTCGTGGGCGCCTCCTGTCTGTGGGTAAGA |
|---|---|---|---|---|---|
| CLLD7 | CLLD7 X9 C258T | | CGTCTGCAGCCAAGACGCAGGGTGGGCACGTGTACATGT GGGGCCAGTGCCGGGGTCAGTCCGTGATCCTCCCGCACC TCACCCACTTCTCCTGCACCGA | M | GACGTGTTTGCCTGCTTTGCCACTCCCGCCGTCTC GTGGGCGCCTCCTGTCTGTGGGTAAGAAAGTGCAGG GCCACCTCCACCCAGGAAGAATGGTACTAC |
| CLLD7 | CLLD7 X9 C285G | | ACGTGTACATGTGGGGCCAGTGCCGGGGTCAGTCCGTGA TCCTCCCGCACCTCACCCACTTCTCCTGCACCGACGACGT GTTTGCCTGCTTTGCCACTCC | Y | GCCGTCTCGTGGGCGCCTCCTGTCTGTGGGTAAGAA AGTGCAGGGCCACCTCCACCCAGGAAGAATGGTAC TACCAACTGACCAGTTTTCCTGTGTCTTTG |
|  |  |  |  | S |  |

Table 4C cont'd

| CLLD7 | CLLD7 X13 A220G | AAGTTACACAGACTGCAGCATTTTGGCAAATGGATGGCCC TCTGCTAAAGGAATTCATTGCTAAAGCCAGTAAATGTGGA GCCTTTAAGAACTGAAGCGC | R | AGGCTGCTGGGTTCTGTCTGTGAGTGCTCTGGGCAC TGTTGAGGATGTGTCCAGTTGTGCTCTACGGGTG ATGTGATTCTGCAGGTAAAAGACCATCAGG |
| --- | --- | --- | --- | --- |
| CLLD7 | CLLD7 X13 C499G | TAAACAACCCTGTGTTTCCAGATAAGTGTATTTTAAATGTGA CCTTTCGTAAATTTGGGGCTGGAACATGTAAAAGGGTGAAA GTTAGTCGTTTTTGGGTCTT | S | TTTTCATTTTGATTAGAGGAACTTCTGAACTTGGAA AGGGAAGTTGGCAGCAACTCTCCTGGGCCACGTA TCAACAATCTTCTGACAGCAGGAGCAGT |
| CLLD7 | CLLD7 X13 C568T | AAAAGGGTGAAAGTTAGTCGTTTTTGGTCTTCTTTTCATTT TTGATTAGAGGAACTTCTGAACTTGGAAAGGGGAAGTTGG CAGCAACTCTCCTGGGCCA | Y | GTATCAACAATCTTCTGACAGCAGGAGCAGTGATAG TTGGGGAATTGTGAGATGAATGGAGAGGCCCCATC GTGAATTAAAGATGCTGACCTGGGATTG |

Table 4C cont'd

| | | | |
|---|---|---|---|
| CLLD7 | CLLD7 X13.2 RS1062979 | CATTAAGGTAGAACTTGAGAACTCAAGTTTAAATTGTCCCCCACCACCTTCTTCTATAAATGCAAACTTAAGAGGAAAATAATGACATGTATAGTATACT | S | TTGCCTTCCTAAATTATGACTGCTGAATCATCATATCTACTATATGACTGAAGAAGTGGTTCTTCAAGTCAACCCTCTTACAAGACTTAGT:GGAAT |
| CLLD7 | CLLD7 X13.2 RS1046027 | TCTATAAATGCAAACTTAAGAGGAAAATAATGACTGCTGAATCATCAGTATACTCTTGCCTTCCTAAATTATGACTGAAGAAGTGGTTCTTCAAGTCAACCCTCTTACAAGATATCTACTATATATGACT | R | GAAGAAGTGGTTCTTCAAGTCAACCCTCTTACAAGACTTAGT:GGAATTTGCTTTATCTACTTAGGCCAAATCCATCACACACATTGGCTTATGTGAAACT |
| CLLD7 | CLLD7 X13.2 RS1046028 | ATGTATAGTATACTCTTGCCTTCCTAAATTATGACTGCTGAATCATCATATCTACTATATATGACTGAAGAAGTGGTTCTTCAAGTCAACCCTCTTACA | R | GACTTAGT:GGAATTTGCTTTATCTACTTTAGGCCAAATCCATCACACACATTGGCTTATGTGAAACTTTATCATCTTTCACTTTTGGTTTTCCCTCTGTTT |

Table 4C cont'd

| Gene | Variant | Sequence 1 | Code | Sequence 2 |
|---|---|---|---|---|
| CLLD7 | 15 BASE DELETION AT POS 684 | CTGGAAGAAGTGGTTCTTCAAGTCAACCCTCTTACAAGAC TTAGT:GGAATTGCTTTATCTACTTTAGGCCAAATCCATCA CACATTGGCTTATGTGAAA | (CTTTATCA TCTTTCA) | CTTTATCATCTTTCACTTTTGGTTTTCCTCTGTTTT AAACATCTTAGGTATAACAGCACAATTTCACCTTGA AAAAGCACCAAAATTATGGTGTTCCTG |
| CLLD7 | CLLD7 X13.3 RS1046034 | GAACCTGAGCCTGAATACATTTTCAGAGCCAAATTACAA GTGGGTGAAGACATGCTACAACTACTATTTTAGCAATGT TTTAAATTGTGTCTATTG | K | GGTGGGAAGGGAGTGAGGCCCTAAAGATAGGAA TTCACTGATAGCTGAAATAGATACAAGCCTAGGAGC CCCAGCCCCCTTTTCTTGACCATATCACAA |
| CLLD7 | CLLD7 RS942870 | TAATTATAATTCATCATACCTCATTTTTTGGCCAGCTGA AACAATGAATAAAATGTTACAAAAAGTAAAAATGAAAATTTC TCTGCTTACAATAACT | R | TATGAATTAAGAGGCTTTTTAAACATATAAAACTGT AACTTTTAAATTCAATACCTTTGGGGAACAGGT GGTTTCAGGTTACATGGATAAGTTCTT |

Table 4C cont'd

| CLLD7 | CLLD7 X13.3 T304C | TTCAACTGTGAGTTTCATCATGTGTCCGTTGAGCTTGCTTTAAGAGCAATGTTTTGCTTTGCTCTCTGCTTCCATGAACTCATTTCCATTGAGTGAG | | TCCCTTAGTGAATTTTGTCTCCTGCTTGGAAAGTCTCTCTTCTGAACCTGAGCCTGAATACATTTTCAGAGCCAAATTACAAGTGGGTGAAGACATGCT |
|---|---|---|---|---|
| CLLD7 | CLLD7 X13.4 C1201 | GTTAGAATTCGTTCTACAACATGATAGAACTTTTCTACTAGCTTCAGAAATGCACATTGATTGTGCTATAGGCTTATGGGGTGTTTGTAACAATCACTGTT | Y | TATAGGCTTATGATCTGAGCAAAATGTGAACTTCAGTATGTTTACTATTGCTCTTACTTGAAAACTTTTTCAAAAAAGCACAAATTAAAGTAGTAAA |
| CLLD7 | 1 BASE DELETION AT POS 153 | TCTTACTAGCTTCAGAAATGCACATTGATTGTGCTATGATGGGTGGTGTTTGTAACAATCACTGTTGTTCTATAGGCTTATGATCTGAGCAAAATGTGAACTT | (T) | CAGTATGTTTACTATTGCTCTTACTTGAAAACTTTTTTCAAAAAAGCACAAATTAAAGTAGTAATTCATATCCATAGATAGTTCATTCAACAA |

Table 4C cont'd

| CLLD7 | 6 BASE INSERTION STARTING AT POS 371 | AATATAAGTGAAGGACCACTTCTCATATTAGATTACTAAGTCATTTGTATGAATATGTGGCAGTGAAGAGAACAGGTCTTTCAAAAAGCATTTGATTA | (TCTTTA) | TTTTTTTAAATACACTCTCTTATTTTCTACTTGTTTTTTGTTAATCATAGCAGGATATGACAACTCTTATTGAATTGATTTTTCATCTAATGTAAT | |

Table 5

| Protein | Peptide Fragment for Ab Production |
|---|---|
|  |  |
| ANGE1 | AQASPPRPERVLGAC |
| ANGE1 | CEDQDPLNPDRSFDV |
| ANGE1 | KRKRGRKKPLSGNHC |
| ANGE1 | AQASPPRPERVLGAC |
| ANGE1 | CEDQDPLNPDRSFDV |
| ANGE1 | KRKRGRKKPLSGNHC |
|  |  |
| CLLD8 | DITKYREETPPRSRC |
| CLLD8 | QKEQENKSNAFPSTSC |
| CLLD8 | CPPKFSNNPKELTME |
| CLLD8 | CNEIDSRKLPQFKYR |
|  |  |
| CLLD7 | GDNQSTLVPKKLEGLC |
| CLLD7 | GSGSTANQPTPRKVT |

Table 6

Putative functional promoter SNPs tested by EMSAs.

| SNP name | Oligo name | oligo sequence with binding areas | SNP type | binding sequence (+for -rev) | T F | Notes |
|---|---|---|---|---|---|---|
| hcv9873896 (REN34) | NR1WT-F | CTCTGCCTCCCGGGTTCAAGC | c/t | CAGAG - | GR | |
| | NR1WT-R | GCTTGAACCCGGGAGGCAGAG | a/g | TGRMCC - | LF-A1 | |
| | NR1MUT-F | CTCTGCCTCCTGGGTTCAAGC | | GAGGC - | T-Ag | |
| | NR1MUT-R | GCTTGAACCCAGGAGGCAGAG | | | | |
| clld7 x1a295t | NR2WT-F | AACGGGGCACTCCCGGCCCGG | a/t | GGGCA + | LF-A1 | |
| | NR2WT-R | CCGGGCCGGGAGTGCCCCGTT | t/a | SCGSSSC +- | GCF | |
| | NR2MUT-F | AACGGGGCACACCCGGCCCGG | | GGGGC+ | T-Ag | |
| | NR2MUT-R | CCGGGCCGGGTGTGCCCCGTT | | | | |
| | | AACGGGGCACTCCCGGCCCGG | | GGGRNNYYCC | NFKB | |
| | | CCGGGCCGGGAGTGCCCCGTT | | | | functional SNP |
| | | AACGGGGCACACCCGGCCCGG | | | | |
| | | CCGGGCCGGGTGTGCCCCGTT | | | | |
| clld7 prom1 a351g | NR3WT-F | CACGGGCTCCTGCTCTGCTCC | c/t | CAGAG - | GR | |
| | NR3WT-R | GGAGCAGAGCAGGAGCCCGTG | a/g | | | |
| | NR3MUT-F | CACGGGCTCCCGCTCTGCTCC | | | | |
| | NR3MUT-R | GGAGCAGAGCGGGAGCCCGTG | | | | |
| clld8x1 a384g | NR4WT-F | TCCAACCTCCATTTCAGCCTG | a/g | TCCA + | NF I | |
| | NR4WT-R | CAGGCTGAAATGGAGGTTGGA | c/t | | | functional SNP |
| | NR4MUT-F | TCCAACCTCCGTTTCAGCCTG | | | | |
| | NR4MUT-R | CAGGCTGAAACGGAGGTTGGA | | | | |

ANGE GENE IN ATOPY

CROSS-REFERENCE TO RELATED APPLICATIONS

This application is a continuation of U.S. application Ser. No. 10/481,613, filed Sep. 14, 2004 (Abandoned), which is a National Stage application under 35 U.S.C. § 371 of (and claims benefit under 35 U.S.C. § 119(a) to) International Application No. PCT/GB02/02859 having an International Filing Date of Jun. 21, 2002, which claims benefit of GB 0115211.5, filed Jun. 21, 2001; GB 0115212.3, filed Jun. 21, 2001; and GB 0115213.1, filed Jun. 21, 2001. This application claims benefit of priority to International Application No. PCT/GB02/02859, filed Jun. 21, 2002; GB 0115211.5, filed Jun. 21, 2001; GB 0115212.3, filed Jun. 21, 2001; and GB 0115213.1, filed Jun. 21, 2001.

REFERENCE TO SEQUENCE LISTING SUBMITTED ON A COMPACT DISC

This application includes a compact disc (Disc 2 of 2, submitted in duplicate) containing a sequence listing. The entire content of the sequence listing is herein incorporated by reference. The sequence listing is identified on the compact disc as follows.

| File Name | Date of Creation | Size (KB) |
| --- | --- | --- |
| 16721-003002.TXT | Jun. 30, 2006 | 1,084 |

The present invention relates to isolated nucleic acid sequences of ANGE, CLLD8 and CLLD7 or sequences complementory or substantially homologous thereto or fragments thereof. Also provided are sequences comprising hybrid nucleic acid sequences from two or more of the genes. Also provided are nucleic acid expression vectors, polypeptides, antibodies to the polypeptides, host cells, non-human transgenic animals and pharmaceutical compositions and agents. Also provided is the use of the nucleic acid sequence and/or protein in medicine and research, methods for diagnosing or determining predisposition to disease or severity of disease, methods for preventing or treating disease, and kits for use in the methods and the use of the nucleic acid sequence and protein in treating or preventing IgE mediated diseases and non-atopic asthma, and in screens for identifying new agents for use in the methods.

Atopic or Immunoglobulin E (IgE) mediated diseases include, but are not limited to, asthma, hayfever, eczema, atopic dermatitis and allergic rhinitis. These disorders are a major cause of disease in children and young adults (Jarvis, D. & Burney, P. *British Medical Journal* 316, 607-10 (1998) [published erratum appears in BMJ 1998 Apr. 4; 316(7137): 1078]; and Cookson, W. *Nature* 402, B5-11 (1999).

Atopy and asthma are due to the interaction between strong environmental and genetic factors (Cookson, W. *Nature* 402, B5-11 (1999). Asthma is usually recognised epidemiologically by standard symptom questionnaires or by physician diagnosis (O'Connor, G. T. & Weiss, S. T. *Am J Respir Crit Care Med* 149, S21-8; discussion S29-30 (1994)). Atopy is detected by skin prick tests, or by measurement of specific serum IgE titres against allergens with RAST or ELISA techniques, or by quantifying the total serum IgE. The examination of quantitative traits offers significant advantages for both linkage and association analyses in general (Risch, N. J. & Zhang, H. *Am J Hum Genet* 58, 836-43 (1996)) and in the case of asthma (Cookson, W. & Palmer, L. *Clin Exp Allergy* 28 Suppl 1, 88-9; discussion 108-10 (1998)). A number of quantitative traits underlie asthma and atopy, including the total serum IgE concentration, the Skin Test Index (STI), the RAST index and the Dose-Response Slope (DRS) of bronchial responsiveness to methacholine (Daniels, S. E. et al. *Nature* 383, 247-50 (1996)). The total serum IgE is log-normally distributed, and has a high heritability (Gerrard, J., Rao, D. & Morton, N. *Am J Hum Genet* 30, p 46-58 (1978)) and Palmer, L. J. et al. *Am J Respir Crit Care Med* 161, 1836-43 (2000)). It is influenced by genetic effects, which incompletely overlap DRS and the STI.

The heritability of physician-diagnosed asthma is 60-70%[7] and that of the (log normal) total serum IgE concentration is 40-50%[8,9]. The heritability of the STI is lower and is approximately 30%[9]. The examination of quantitative rather than categorical traits offers significant advantages of power for both linkage and association analyses in general[10] and in the case of asthma[11]. The total serum IgE is log-normally distributed with standardised measurement protocols, and the effects of age and sex are well defined[12]. Consequently, we have used the total serum IgE as quantitative trait to map susceptibility genes for atopy and asthma.

Differing indices of atopy may be elevated in the same family (Cookson, W. O. C. M. & Hopkin, J. M. *Lancet* 1, 86-88 (1988) and Young, R. P., Lynch, J., Sharp, P. A. & et al. *Journal of Medical Genetics* 29, 236-238 (1992)). RAST and skin test responses reach a peak later in childhood than the total serum IgE, and decline at a slower rate thereafter (Cline, M. G. & Burrows, B. B. *Thorax* 44, 425-431 (1989)). To account for this heterogeneity of phenotype (pleiotropy), the categorical trait of "atopy" is based on a combination of the STI, RAST index, and the total serum IgE (Daniels, S. E. et al. *Nature* 383, 247-50 (1996) and Cookson, W. O. C. M. & Hopkin, J. M. *Lancet* 1, 86-88 (1988)).

Atopy is due to the interaction between genetic and environmental factors. The genetic factors are thought to be variants of DNA structure ("polymorphisms") that alter the level of expression or the function of genes to predispose to asthma. Variants of DNA sequence at a particular site ("locus") are known as "alleles". Genome-wide scans for linkage to atopy and asthma-associated phenotypes have been conducted (Daniels, S. E. et al. *Nature* 383, 247-50 (1996)). Strong linkage of the atopy phenotype to chromosome 13q14 was observed, and confirmed in a second panel of families at the time of our initial genome screen. An earlier study had found linkage of the total serum IgE to the esterase D (ESD) protein polymorphism on chromosome 13q14 (Eiberg, H., et al. *Cytogenetics. And Cell Genetics* 40, 622 (1985)). Linkage to the region has also been confirmed by a single locus study of Japanese families (Kimura, K. et al. *Hum Mol Genet* 8, 1487-90 (1999)). A two-stage screen in Hutterite families from the US found linkage of asthma to 13q21.3 (Ober, C. et al., The Collaborative Study on the Genetics of Asthma. *Hum Mol Genet* 7, 1393-8 (1998)) in the first stage families but not in the second. Linkage to 13q14 has also been observed to house dust mite allergy in children with asthma (Hizawa, N. et al. Collaborative Study on the Genetics of Asthma (CSGA). *J Allergy Clin Immunol* 102, p436-42 (1998)), and to children with atopic dermatitis (Beyer K, W. U et al *J Allergy Clin Immunol* 101, 152 (1998)). These results suggest that chromosome 13 contains an important atopy locus. A locus for atopic dermatitis has recently been mapped to the same region of chromosome 13-13q14. Susceptibility loci for atopic dermatitis on chromosomes 3, 13, 15, 17 and 18 in a Swedish population: Bradley M, Soderhall C, Luthman H, Wahlgren C F, Kockum I, Nordenskjold M Hum Mol Genet 2002 Jun. 15; 11(13):1539-48.

Close localisation of disease causing genes may be accomplished by the detection of associations between particular alleles and the disease phenotype. Over short segments of DNA, distinctive alleles of the individual polymorphisms will show non-random association with alleles of neighbouring polymorphisms. This phenomenon, known as "linkage disequilibrium" typically occurs over 50-500 Kilobases (Kb) of DNA (Jorde, L. B. et al. *Am J Hum Genet* 54, 884-98 (1994); Collins, A., Lonjou, C. & Morton, N. E. *Proc Natl Acad Sci U S A* 96, 15173-7 (1999) and Abecasis, G. R. et al. *Am J Hum Genet* 68, 191-197 (2001)), and associations between polymorphism and disease are in general unlikely to extend beyond 500 Kb. Linkage disequilibrium may be detected by the study of individuals and by the study of families.

Disease causing alleles will be in linkage disequilibrium with non-functional polymorphisms from the same chromosomal segment. It is therefore possible to detect allelic association with disease from particular chromosomal segments, without identifying the exact polymorphism and gene underlying the disease state.

The detection of allelic association may therefore give information as to disease susceptibility in a particular individual. Furthermore, allelic association is indicative of a disease-causing gene being present within a limited distance of DNA in either direction from the allele.

Identification of the disease causing gene will allow the identification of children at risk of atopy before the disease has developed (for example immediately after birth), with the potential for prevention of disease. Knowledge of the gene and its activity will enable predictions to be made regarding the type of disease (i.e. asthma, dermatitis or allergies) and the clinical course of disease (e.g. severe as opposed to mild) or the response to particular treatments. This diagnostic information will be of use to the health care, pharmaceutical and insurance industries.

According to a first aspect of the invention there is provided an isolated or recombinant nucleic acid sequence comprising a sequence as shown in FIG. 5a, or a sequence which excludes one or more of the exons as set out in FIG. 3a or a sequence complementary or substantially homologous thereto, or a fragment thereof. The sequence of FIG. 5a comprises the human ANGE, CLLD7 and CLLD8 nucleotide sequences. FIG. 5b (i) shows the Exon sequences of the ANGE gene including the 2 alternative first exons; FIG. 5b (ii) shows the ANGE mRNA sequence and 5b (iii) the translated protein sequence. The NY-REN-34 mRNA sequence is shown in FIG. 5c (i) and the protein sequence of NY-REN-34 in FIG. 5c (ii) an alternative NY-REN-34 protein sequence is shown in FIG. 5c (iii).

For the purposes of the present invention, the ANGE gene is the gene known in the prior art as NY-REN-34, and shown as nucleotides 313649-346509 of BAC bA103J18.03548 (FIG. 5a). References to the ANGE gene in the present application include variant sequences showing 80%, 81%, 82%, 83%, 84%, 85%, 86%, 87%, 88%, 89%, 90%, 915, 92%, 93%, 95%, 96%, 97%, 98%, 99% or 100% homology with the ANGE gene of FIG. 5a and preferably sharing one or more functional characteristics with the ANGE gene.

The ANGE nucleic acid sequence can comprise any combination of one or more exons from FIGS. 3a, 5b (i) and Table 5 or a sequence substantially homologous thereto, or a fragment thereof. These combinations are for all ANGE sequences including human and mouse.

All the sequences of the present invention are isolated, or alternatively may be recombinant. By isolated is meant a nucleic acid or polypeptide sequence which has been purified, and is substantially free of other protein and nucleic acid. Such sequences may be obtained by PCR amplification, cloning techniques, or synthesis on a synthesiser. By recombinant is meant nucleic acid sequences which have been recombined by the hand of man.

The polynucleotide sequences of the invention may be genomic or cDNA, or RNA, preferably mRNA, or PNA or other nucleic acid analogue known to the person skilled in the art. In the present invention, gene products include polynucleotide sequences and protein. References to polypeptide sequences include proteins and peptides.

The public domain REFSEQ entries for the mRNA sequences of CLLD7, CLLD8 and NY-REN-34 are NM_018191.2, NM_031915.1 and NM_016119.1 respectively. These show minor differences at the nucleotide level to the sequences shown above. However for NY-REN-34 these alterations result in a truncated putative protein compared to our sequence which is shown below.

In the present application, sequences which are complementary or substantially homologous are those sequences which hybridise under stringent conditions to the defined sequence or its gene products. Thus, for example, a nucleic acid sequence substantially homologous to a reference nucleic acid will be capable of hybridising to a gene product (i.e. mRNA) of the reference nucleic acid, under stringent conditions. A complementary sequence is one which is capable of hybridising to the nucleic acid sequence itself, under stringent conditions. Also provided in the present invention are complements of the substantially homologous sequences. A substantially homologous sequence preferably has at least 75, 76, 77, 78, 79, 80, 81, 82, 83, 84, 85, 86, 87, 88, 89, 90, 91, 92, 93, 94, 95, 96, 97, 98 or 100% sequence identity with the defined sequence. This definition of substantially homologous applies to both nucleic acid and polypeptide sequences. Thus, polypeptide sequences having conservative amino acid substitutions that do not affect structure or function are also included. For any given DNA sequence, references to a complementary sequence include the corresponding mRNA sequence and any cDNA sequence derived on such an RNA sequence.

"% identity" is a measure of the relationship between two nucleic acid or polypeptide sequences, as determined by comparing their sequences. In general, the two sequences to be compared are aligned to give a maximum correlation between the sequences. The alignment of the two sequences is examined and the number of positions giving an exact amino acid or nucleotide correspondence is determined, and divided by the total length of the alignment, and the result is multiplied by 100 to give a % identity. The % identity may be determined over the whole length of the sequence to be compared, which is particularly suitable for sequences of the same or similar lengths or for sequences which are highly homologous, or over shorter defined lengths which is more suitable for sequences of unequal lengths and with a lower homology.

Methods for comparing the identity of two or more sequences are known in the art. For example, programs available in the Wisconsin Sequence Analysis Package version 9.1 (Devereux J et al., *Nucl Acid Res* 12 387-395 (1984), available from Genetics Computer Group, Madison, Wis., USA), such as BESTFIT and GAP may be used.

BESTFIT uses the "local homology" algorithm of Smith and Waterman (Advances in Applied Mathematics, 2:482-489, 1981) and finds the best single region of similarity between two sequences. BESTFIT is more suited to comparing two polynucleotide or two polypeptide sequences which are dissimilar in length, the program assuming that the shorter sequence represents a portion of the longer. In comparison, GAP aligns two sequences finding a "maximum similarity" according to the algorithm of Neddleman and Wunsch (J. Mol. Biol. 48:443-354, 1970). GAP is more suited to comparing sequences which are approximately the same length and an alignment is expected over the entire length. Preferably, the parameters "Gap Weight" and "Length Weight" used in each program are 50 and 3 for polynucleotide sequences and 12 and 4 for polypeptide sequences, respectively. Preferably, % identities and similarities are determined when the two sequences being compared are optimally aligned.

Other programs for determining identity and/or similarity between sequences are also known in the art, for instance the BLAST family of programs (Altschul et al, *J. Mol. Biol.*, 215:403-410, (1990) and Altschul et al, *Nuc Acids Res.*, 25:289-3402 (1997), available from the National Center for Biotechnology Information (NCB), Bethesda, Md., USA and accessible through the home page of the NCBI at www.ncbi.nlm.nih.gov) and FASTA (Pearson W. R. and Lipman D. J., *Proc. Nat. Acac. Sci.*, USA, 85:2444-2448 (1988), available as part of the Wisconsin Sequence Analysis Package). Preferably, the BLOSUM62 amino acid substitution matrix (Henikoff S. and Henikoff J. G., *Proc. Nat. Acad. Sci.*, USA, 89:10915-10919, (1992)) is used in polypeptide sequence comparisons including where nucleotide sequences are first translated into amino acid sequences before comparison.

Preferably, the program BESTFIT is used to determine the % identity of a query polynucleotide or a polypeptide sequence with respect to a polynucleotide or a polypeptide sequence of the present invention, the query and the reference sequence being optimally aligned and the parameters of the program set at the default value.

In relation to the present invention, "stringent conditions" refers to the washing conditions used in a hybridisation protocol. In general, the washing conditions should be a combination of temperature and salt concentration so that the denaturation temperature is approximately 5 to 20° C. below the calculated $T_m$ of the nucleic acid under study. The $T_m$ of a nucleic acid probe of 20 bases or less is calculated under standard conditions (1M NaCl) as [4° C.×(G+C)+2° C.×(A+T)], according to Wallace rules for short oligonucleotides. For longer DNA fragments, the nearest neighbour method, which combines solid thermodynamics and experimental data may be used, according to the principles set out in Breslauer et al., *PNAS* 83: 3746-3750 (1986). The optimum salt and temperature conditions for hybridisation may be readily determined in preliminary experiments in which DNA samples immobilised on filters are hybridised to the probe of interest and then washed under conditions of different stringencies. While the conditions for PCR may differ from the standard conditions, the $T_m$ may be used as a guide for the expected relative stability of the primers. For short primers of approximately 14 nucleotides, low annealing temperatures of around 44° C. to 50° C. are used. The temperature may be higher depending upon the base composition of the primer sequence used. Suitably stringent conditions are those under which non-specific hybridisation (e.g. to non-DPP10 encoding sequences) are avoided. Suitable stringent conditions are 0.5×SSC/1% SDS/58° C./30 mins for a 21mer oligonucleotide probe.

The complementary sequences of the invention (which may also be referred to herein as "antisense") may be useful as probes or primers, or in the regulation of ANGE expression. Preferably, the primer sequences are capable of amplifying all or a portion of an ANGE gene. Preferred primer sequences are disclosed in the Examples and Table 4. Pairs of primers for amplification of all or part of the gene, or alleles, or variants thereof, form another aspect of the invention. Similarly, ANGE probes will be useful in detecting the presence or expression levels of ANGE, or variant forms thereof, in a sample from a subject. The probes may also be useful in analysing the expression pattern of ANGE in a subject.

In the present application, fragments are any contiguous 10 residue sequence, or greater, such as 20, 30, 40, or 50 residue sequence. Preferably, fragments of nucleic acid or polypeptide sequences share one or more functional characteristics with ANGE or its gene, or are capable of modulating (i.e. inhibiting or enhancing) such a functional characteristic. The novelty of a fragment according to the present embodiment may be easily ascertained by comparing the nucleotide or polypeptide sequence of the fragment with sequences catalogued in databases such as Genebank at the priority date, or by using computer programs such as DNA-SIS (Hitachi Engineering Inc) or Word Search or FASTA of the Genetic Computer Group (Madison, USA).

The fragments may be used in a variety of diagnostic, prognostic or therapeutic methods or may be useful as research tools for example in screening. Fragments of the sequences of the first aspect or their complements may be used as primer sequences as described above.

In a second aspect of the invention there is provided an isolated or recombinant nucleic acid sequence comprising a sequence as shown in FIG. 5a or a sequence as shown in FIG. 5a which excludes one or more of the exon sequences as set out in FIG. 5e (i) and Table 5 or a sequence complementary or substantially homologous thereto or a fragment thereof. The CLLD8 mRNA sequence is shown in FIG. 5e (ii) and the CLLD8 protein sequence in FIG. 5e (iii). The nucleotides 294727 to 309803 of FIG. 5a is the human CLLD8 nucleic acid sequence.

In a third aspect of the invention there is provided an isolated or recombinant nucleic acid sequence comprising a sequence as shown in FIG. 5a or a sequence as shown in FIG. 5a which excludes one or more of the exon sequences as set out in FIG. 5d (i) and Table. The CLLD7 mRNA sequence is shown in FIG. 5d (ii) and the CLLD7 protein sequence in FIG. 5d (iii). The nucleotides 349634 to 410846 of FIG. 5a is the human CLLD7 nucleic acid sequence.

In a fourth aspect of the invention there is provided an isolated or recombinant nucleic acid sequence (an isolated or recombinant nucleic acid sequence comprising an ANGE mRNA sequence or a sequence complementary or substantially homologous thereto, or a fragment thereof) comprising a sequence as shown in FIG. 5a (nucleotides 313649-346509) (ANGE) contiguous with an isolated or recombinant nucleic acid sequence (an isolated or recombinant nucleic acid sequence comprising a CLLD8 mRNA sequence or a sequence complementary or substantially homologous thereto, or a fragment thereof) comprising a sequence as shown in FIG. 5a (nucleotides 294727-309803) (CLLD8) or a sequence complementary or substantially homologous thereto or a fragment thereof.

Alternatively, there is provided an isolated or recombinant polynucleotide sequence comprising the CLLD8 gene and ANGE gene, wherein both genes are under the control of a single regulatory element. Preferably, the regulatory element is a promoter. More preferably, the regulatory element is the CLLD8 promoter.

Alternatively, there is provided an isolated or recombinant polynucleotide sequence encoding a protein having the domain structure Pre-SET-SET-Post-SET-PHD-PHD. Preferably, the domain structure is CpGBD-Pre-SET-SET-Post-SET-PHD-PHD. SET and PHD domains will be known to persons skilled in the art.

Preferably, the polynucleotide sequences of the fourth aspect encode a single gene product comprising both CLLD8 and ANGE. This composite gene product is produced as a splice product of the CLLD8 gene, under control of the CLLD8 promoter, and comprises the ANGE gene product. This composite CLLD8-ANGE gene product results from splicing together of the CLLD8 and ANGE genes and is shown to be involved in atopy.

In a fifth aspect of the invention there is provided an isolated or recombinant nucleic acid sequence (an isolated or recombinant nucleic acid sequence comprising an ANGE mRNA sequence or a sequence complementary or substantially homologous thereto, or a fragment thereof) comprising a sequence (nucleotides 313649-346509) as shown in FIG. 5a (ANGE) contiguous with an isolated or recombinant nucleic acid sequence (an isolated or recombinant nucleic acid sequence comprising a CLLD7 mRNA sequence or a sequence complementary or substantially homologous thereto, or a fragment thereof) comprising a sequence (nucleotides 349634 to 410846) as shown in FIG. 5a (CLLD7) or a sequence complementary or substantially homologous thereto or a fragment thereof.

Alternatively, there is provided an isolated or recombinant polynucleotide sequence comprising the ANGE gene and CLLD7 gene, wherein both genes are under the control of a single regulatory element. Preferably, the regulatory element is a promoter. More preferably, the regulatory element is the ANGE promoter.

Preferably, the polynucleotide sequences of the fifth aspect encode a single gene product comprising both ANGE and CLLD7. This composite gene product is produced as a splice product of the ANGE gene, under control of the ANGE promoter, and comprises the CLLD7 gene product. This composite CLLD7-ANGE gene product results from splicing together of the CLLD7 and ANGE genes and is shown to be involved in atopy.

In a sixth aspect of the invention there is provided an isolated or recombinant nucleic acid sequence comprising a sequence (an isolated or recombinant nucleic acid sequence comprising a CLLD8 mRNA sequence or a sequence complementary or substantially homologous thereto, or a fragment thereof) comprising a sequence (nucleotides 294727-309803) as shown in FIG. 5a (CLLD8) contiguous with an isolated or recombinant nucleic acid sequence as claimed in claim 3 comprising a sequence (nucleotides 349634 to 410846) as shown in FIG. 5a (CLLD7) or a sequence complementary or substantially homologous thereto or a fragment thereof.

Alternatively, there is provided an isolated or recombinant polynucleotide sequence comprising the CLLD8 gene and CLLD7 gene, wherein both genes are under the control of a single regulatory element. Preferably, the regulatory element is a promoter. More preferably, the regulatory element is the CLLD7 promoter.

Preferably, the polynucleotide sequences of the sixth aspect encode a single gene product comprising both CLLD8 and CLLD7. This composite gene product is produced as a splice product of the CLLD8 gene, under control of the CLLD8 promoter, and comprises the CLLD7 gene product. This composite CLLD8-CLLD7 gene product results from splicing together of the CLLD8 and CLLD7 genes and is shown to be involved in atopy.

In a seventh aspect of the invention there is provided an isolated or recombinant nucleic acid sequence comprising a sequence (an isolated or recombinant nucleic acid sequence comprising an ANGE mRNA sequence or a sequence complementary or substantially homologous thereto, or a fragment thereof) comprising a sequence (nucleotides 313649-346509) as shown in FIG. 5a (ANGE) contiguous with an isolated or recombinant nucleic acid sequence (an isolated or recombinant nucleic acid sequence comprising a CLLD8 mRNA sequence or a sequence complementary or substantially homologous thereto, or a fragment thereof) comprising a sequence (nucleotides 294727-309803) as shown in FIG. 5a (CLLD8) and contiguous with an isolated or recombinant nucleic acid sequence (an isolated or recombinant nucleic acid sequence comprising a CLLD7 mRNA sequence or a sequence complementary or substantially homologous thereto, or a fragment thereof) comprising a sequence (nucleotides 349634 to 410846) as shown in FIG. 5a (CLLD7) or a sequence complementary or substantially homologous thereto or a fragment thereof.

Alternatively, there is provided an isolated or recombinant polynucleotide sequence comprising the ANGE gene, the CLLD8 gene and the CLLD7 gene, wherein all the genes are under the control of a single regulatory element. Preferably, the regulatory element is a promoter. More preferably, the regulatory element is the CLLD8 promoter.

Preferably, the polynucleotide sequences of the seventh aspect encode a single gene product comprising CLLD8, ANGE and CLLD7. This composite gene product is produced as a splice product of the CLLD8 gene, under control of the CLLD8 promoter, and comprises the ANGE and CLLD7 gene products. This composite CLLD8-ANGE-CLLD7 gene product results from splicing together of the CLLD8, ANGE and CLLD7 genes and is shown to be involved in atopy.

By the terms "ANGE" "CLLD7" and "CLLD8" are meant either the complete gene product, or a part or parts thereof. Parts of the gene products are preferably splice variants, and preferably include at least one exon or a transcript produced from at least one exon. Thus, the gene product of the fourth to seventh aspects include at least one exon or part of an exon of CLLD7, CLLD8 and ANGE.

In an eighth aspect of the invention there is provided an isolated or recombinant nucleic acid sequence comprising at least a part of the sequence of FIG. 5a, and comprising one or more SNPs at positions, which correspond to the positions of FIG. 5a listed in Table 1.

Particular isolated nucleic acid molecules include those:

as shown in Table 2c;
    comprising a SNP at the position corresponding to position 185752b_2 of FIG. 5a;
    comprising a SNP at the position corresponding to position 185752b5_3 of FIG. 5a;
    comprising a SNP at the position corresponding to position 4321017b38_1 of FIG. 5a.

The isolated or recombinant nucleic acid molecules of the eighth aspect of the present invention are different to the "wild type" or "reference" sequence of FIG. 5a.

This aspect of the invention also provides antisense sequences. Such sequences are typically single stranded and are capable of hybridising to the above mentioned nucleic acid sequences of the invention, or to the sequence of FIG. 5a under stringent conditions. Preferred antisense sequences are those which are capable of hybridising to an allele of a polymorphism of the invention, and most preferably is capable of distinguishing between alleles of a polymorphism (of Table 1). Stringent conditions are defined below. The antisense sequences may be prepared synthetically or by nick translation, and are preferably isolated or recombinant.

The antisense sequences include primers and probes, for example, for use in the methods of the present invention. Primer sequences are capable of acting as an initiation site for template directed nucleic acid synthesis, under appropriate conditions, which will be known to skilled persons. Probes are useful in the detection, identification and isolation of particular nucleic acid sequences. Probes and primers are preferably 15 to 30 nucleotides in length.

For amplification purposes, pairs and primers are provided. These include a 5' primer, which hybridises to the 5' end of the nucleic acid sequence to be amplified, and a 3' primer, which hybridises to the complementary strand of the 3' end of the nucleic acid to be amplified. Preferred primers are those listed in Table 4.

Probes and primers may be labelled, for example to enable their detection. Suitable labels include for example, a radiolabel, enzyme label, fluoro-label, and biotin-avidin label for subsequent visualisation in, for example, a southern blot procedure. A labelled probe or primer may be reacted with a sample DNA or RNA, and the areas of the DNA or RNA which carry complimentary sequences will hybridise to the probe, and become labelled themselves. The labelled areas may be visualised, for example by autoradiography.

Preferably, the probes and/or primers hybridise under, "stringent conditions", which refers to the washing conditions used in a hybridisation protocol. The hybridisation conditions for probes are preferably sufficiently stringent to allow distinction between different alleles of a polymorphism upon binding of the probes. In general, the washing conditions should be combination of temperature and salt concentration so that the denaturation temperature is approximately 5 to 20° C. below the calculated $T_m$ of the nucleic acid under study. The $T_m$ of a nucleic acid probe of 20 bases or less is calculated under standard conditions (1M NaCl) as [4° C.×(G+C)+2° C.×(A+T)], according to Wallace rules for short oligonucleotides. For longer DNA fragments, the nearest neighbour method, which combines solid thermodynamics and experimental data may be used, according to the principles set out in Breslauer et al., PNAS 83: 3746-3750 (1986). The optimum salt and temperature conditions for hybridisation may be readily determined in preliminary experiments in which DNA samples immobilised on filters are hybridised to the probe of interest and then washed under conditions of different stringencies. While the conditions for PCR may differ from the standard conditions, the $T_m$ may be used as a guide for the expected relative stability of the primers. For short primers of approximately 14 nucleotides, low annealing temperatures of around 44° C. to 50° C. are used. The temperature may be higher depending upon the base composition of the primer sequence used. Typically, the salt concentration is no more than 1M, and the temperature is at least 25° C. Suitable conditions are 5×SSPE (750 mM NaCl, 50 mM NaPhosphate, 5 mM EDTA pH 7.4) and a temperature of 25-30° C.

The use of one or more of the SNP markers of Table 1 in the identification of a gene or genetic element which influences IgE mediated disease or non-atopic asthma is also included. As is the use of one or more of the SNP markers in medicine or in the identification of an agent for use in the diagnosis, prevention or treatment of an IgE mediated disease or non-atopic asthma.

In a preferred embodiment the SNP marker is as shown in Table 2c, or 185752b4_2, 185752b5_3, 432103b43_1 or 4321017b38_1 or any SNP in linkage disequilibrium with the SNP markers selected in Table 1. The polynucleotides of the first to eight aspects are used in the diagnosis of individuals having an IgE mediated disease or non-atopic asthma, or in the treatment of individuals having such disease. The polynucleotides may also be used in the manufacture of a diagnostic for diagnosing individuals having an IgE mediated disease or non-atopic asthma or in the treatment of individuals having such diseases.

In a ninth aspect of the invention, the isolated nucleic acid sequences of the invention may be provided in the form of a vector to enable the in vitro or in vivo expression of the isolated nucleic acid sequences of any of the first to eighth aspects. Vectors include plasmids, chromosomes, artificial chromosomes and viruses and may be expression vectors, which are capable of expressing nucleic acid sequences in vitro or in vivo, or transformation vectors which are capable of transferring the nucleic acid sequence from one environment to another. The nucleic acid molecules of the invention may be operably linked to one or more regulatory elements including a promoter.

The term regulatory elements includes response elements, consensus sites, methylation sites, locus control regions, post-transcriptional modifications, splice variants, homeoboxes, inducible factors, DNA binding domains, enhancer sequences, initiation codons, secretion signals and, polyA sequences. Regions upstream or downstream of a promoter such as enhancers, which regulate the activity of the promoter, are also regulatory elements.

The vector may also comprise an origin of replication; appropriate restriction sites to enable cloning of inserts adjacent to the polynucleotide molecule; markers, for example antibiotic resistance genes; ribosome binding sites: RNA splice sites and transcription termination regions; polymerisation sites; or any other element, such a secretion signals, which may facilitate the cloning and/or expression of the polynucleotide molecule.

Within a vector the gene may be expressed upstream or downstream of an expressed protein tag such as a histidine tag, V5 epitope tag, green fluorescent protein tag, MHC tag or other such tag known to those skilled in the art. Use of such a tag allows easy localisation, affinity purification and detection of the fusion protein with an antibody to the tag moiety.

Where two or more nucleic acid molecules of the invention are introduced into the same vector, each may be controlled by its own regulatory sequences, or all molecules may be controlled by the same regulatory sequence. In the same manner, each molecule may comprise a 3' polyadenylation site. Examples of suitable vectors will be known to persons skilled in the art and include pBluescript II, lambdaZap, and pCMV-Script (Stratagene Cloning Systems, La Jolla, USA).

Appropriate regulatory elements, in particular promoters, will usually depend upon the host cell into which the expression vector is to be inserted. Where microbial host cells are used, promoters such as lactose promoter system, tryptophan (Trp) promoter system, β-lactamase promoter system or phage lambda promoter systems are suitable. Where yeast cells are used, preferred promoters include alcohol dehydrogenase I or glycolytic promoters. In mammalian host cells, preferred promoters are those derived from immunoglobulin genes, SV40, Adenovirus, Bovine Papilloma virus etc. Suitable promoters for use in various host cells would be readily apparent to a person skilled in the art (See, for example, Current Protocols in Molecular Biology Edited by Ausubel et al, published by Wiley). In addition, the regulatory elements may be modified, for example by the addition of further regulatory elements, to achieve a desired expression pattern.

By operably linked is meant that the components of the vector or sequence are in a relationship which allows them to function as intended.

These vectors may be used to transform host cells, for example, prokaryotic or eukaryotic cells. These cells may be used in the production of recombinant gene products produced from the isolated nucleic acid sequences of the first to eighth aspects, or in the regulation or analysis of the nucleic acid sequences of the first to eighth aspects. The transformed host cells form part of the invention. Preferred cells include E. coli, yeast, filamentous fungi, insect cells, mammalian cells, preferably immortalised, such as mouse, CHO, HeLa, Myeloma or Jurkat cell lines, human and monkey cell lines and derivatives thereof.

According to a tenth aspect of the invention, there is provided a polypeptide sequence comprising a polypeptide sequence encoded by a nucleic acid sequence of the first to eighth aspects of the invention. Preferably the polypeptide sequences are encoded by a nucleic acid sequence of FIG. 5a.

The tenth aspect of the invention includes a polypeptide sequence comprising a polypeptide sequence as shown in any one of FIGS. 5b (iii), 5b (v), 5c (ii), 5c (iii), 5d (iii), 5e (iii) or a sequence homologous thereto, or a fragment thereof. The sequences of FIGS. 5b (iii), 5b (v), 5c (ii), 5c (iii), 5d (iii), 5e (iii) are the predicted human ANGE, CLLD7 and CLLD8 polypeptide sequences respectively.

The ANGE, CLLD7 and CLLD8 polypeptides or sequences substantially homologous thereto or a fragments thereof may be subject to post-translational modification. Post-translational modification (PTM) is defined herein as including modification of a protein following translation by proteolytic cleavage e.g. cleavage of a preprotein, a proprotein or a preproprotein by removal of a signal sequence or activation of a zymogen. PTM also includes the attachment of a carbohydrate to a protein, the predominant sugars attached include glucose, galactose, mannose, fucose, Gal-NAC, GlcNAC and NANA. The carbohydrates may be linked to the protein either by O-glycosidic or N-glycosidic bonds e.g. glycosylation. Also included are acylation; methylation; phosphorylation; sulfation and prenylation. Vitamin C-dependent modifications such as proline and lysine hydroxylation and carboxy terminal amidation and vitamin K-dependent modifications such as carboxylation of glutamine residues are also included as is the addition of selenium as selenocysteine in a protein.

The ANGE, CLLD7 and CLLD8 polypeptides may be operably linked to a secretion signal, to assist their secretion from the golgi apparatus to another part of the cell. Suitable secretion signals can be provided by recombinant vectors such as pSecTag2 (Invitrogen Corporation, Carlsbad, Calif.). Proteins expressed from such vectors are fused at the N-terminus to the murine Ig kappa chain leader sequence. The secretion signal may be linked to the soluble ANGE, CLLD7 and CLLD8 polypeptide sequences using techniques available in the art, including recombinant DNA technology. The polypeptides may be linked to a tag such as a histidine tag, V5 epitope tag, green fluorescent protein tag, MHC tag or other tag known to those skilled in the art or to a carrier molecule known to a person skilled in the art.

The polypeptide sequences of the tenth aspect are preferably functional and may be useful in drug screening, diagnosis or therapy. Functional fragments of ANGE, CLLD7 or CLLD8 are those which share immunological or functional characteristics with the full length, membrane bound or soluble form of ANGE, CLLD7 or CLLD8. Fragments may be at least 10, preferably 15, 20, 25, 30, 35, 40 or 50 amino acids in length. Preferably, the polypeptide sequences are isolated.

In an eleventh aspect of the present invention, there are provided antibodies which are specific for an antigen of a polypeptide sequence of the tenth aspect or an antigen of the isolated nucleic acid of the first to eighth aspects, or fragments of any of said aspects or which react with an antigen of a polypeptide sequence of the tenth aspect or the isolated nucleic acid of the first to eighth aspects, or fragments of any of said aspects. Herein the term "react" has the meaning that the antibody is able to interact with the polypeptide or isolated nucleic acid. The term "specific for" has the meaning that the antibody specifically reacts with the polypeptide or isolated nucleic acid.

Antibodies can be made by the procedure set forth by standard procedures (Harlow and Lane, "Antibodies; A Laboratory manual" Cold Spring Harbour Laboratory, Cold Spring Harbour, N.Y., 1998). Briefly, purified antigen can be injected into an animal in an amount and in intervals sufficient to elicit an immune response. Antibodies can either be purified directly, or spleen cells can be obtained from the animal. The cells are then fused with an immortal cell line and screened for antibody secretion. The antibodies can be used to screen DNA clone libraries for cells secreting the antigen. Those positive clones can then be sequenced as described in, for example, Kelly et al., Bio/Technology 10:163-167 (1992) and Bebbington et al., Bio/Technology 10:169-175 (1992). Preferably, the antigen being detected and/or used to generate a particular antibody will include polypeptide sequences according to the tenth aspect or isolated nucleic acid sequences according to the first to eighth aspects. The antibody may be a polyclonal or monoclonal antibody, a chimeric antibody, a humanised antibody or a bifunctional antibody or a fragment of any of the above. A bifunctional antibody is an antibody that can bind to two different antigens, these antigens may be different antigens present in the ANGE, CLLD7 or CLLD8 polypeptides or isolated nucleic acid or may be an antigen of ANGE, CLLD7 or CLLD8 combined with e.g. a cellular antigen.

In a preferred embodiment polyclonal antibodies are raised against peptide fragments as shown in Table 5.

In particular, the antibody may be raised against a particular domain of ANGE, CLLD7 or CLLD8. Such antibodies will be useful in diagnostic and therapeutic aspects of the invention. In particular, the antibodies will be useful in the development of assays for detecting or measuring ANGE, CLLD7 or CLLD8 individually or as spliced hybrids in a sample.

According to a twelfth aspect of the invention, there is provided a process for the preparation of a nucleic acid sequence as defined above, the process comprising ligating together successive nucleotide and/or oligonucleotide residues. Such a process may be carried out using chemical synthesis methods or by using enzymic catalysis. Alternatively, a suitable host cell may be transfected with an appropriate DNA or RNA sequence so as to cause production of the desired sequence in a host cell.

In a thirteenth aspect of the invention, there is provided a process for the preparation of a polypeptide as defined above, the process comprising ligating together successive amino acids and/or oligopeptides. Such a process may be carried out using chemical synthesis methods or by using enzymic catalysis. Alternatively, a suitable host cell may be transfected with an appropriate DNA or RNA sequence so as to cause production of the desired polypeptide in a host cell. The polypeptide may be produced in a cell free system.

In a fourteenth aspect, there is provided a host cell comprising a vector or isolated or recombinant nucleic acid molecule according to the aforementioned aspects. The host cell may comprise an expression vector, or naked DNA encoding the nucleic acid molecules of the invention. A wide variety of suitable host cells are available, both eukaryotic and prokaryotic. Examples include bacteria such as *E. coli*, yeast, filamentous fungi, insect cells, mammalian cells, preferably immortalised, such as mouse, CHO, HeLa, myeloma or Jurkat cell lines, human and monkey cell lines and derivatives thereof. The host cells are preferably capable of expression of the nucleic acid sequence to produce a gene product (i.e. RNA or protein). Such host cells are useful in drug screening systems to regulate or analyse the polypeptides of the tenth aspect or to identify agents for use in diagnosis or treatment of individuals having, or being susceptible to disease.

The method by which said nucleic acid molecules are introduced into a host cell will usually depend upon the nature of both the vector/DNA and the target cell, and will include those known to a person skilled in the art. Suitable known methods include but are not limited to fusion, conjugation, liposomes, immunoliposomes, lipofectin, transfection, transduction, eletroporation or injection, as described in Sambrook et al.

In a fifteenth aspect of the present invention, there is provided a transgenic non-human animal comprising a nucleic acid sequence according to an aforementioned aspect of the invention. Such transgenic non-human animals are useful for the analysis of single nucleotide polymorphisms and their phenotypic effect and so for the analysis of the ANGE, CLLD7 and CLLD8 gene cluster and its phenotypic effect. Expression of a polynucleotide sequence of the invention in a transgenic non-human animal is usually achieved by operably linking the polynucleotide to a promoter and/or enhancer sequence, preferably to produce a vector of the above aspect, and introducing this into an embryonic stem cell of a host animal by microinjection techniques (Hogan et al., A Laboratory Manual, Cold Spring harbour and Capecchi *Science* (1989) 244: 1288-1292). The transgene construct should then undergo homologous recombination with the endogenous gene of the host. Those embryonic stem cells comprising the desired nucleic acid sequence may be selected, usually by monitoring expression of a marker gene, and used to generate a non-human transgenic animal. Preferred host animals include mice, rabbits and other rodents.

The nucleic acid sequence introduced may not be native to the host animal, i.e. it may be foreign. Such transgenic animals may be distinguished from native, non-transgenic animals using methods known in the art, for example a nucleic acid sample from the transgenic animal may be compared with that from a native animal—the transgenic animal will have a nucleic acid sequence such as a foreign promoter, marker genes etc. Alternatively, the phenotypes of the animals can be compared.

Where it is desirable to use the transgenic non-human animal of the fifteenth aspect to study disease, it may be desirable for the nucleic acid introduced into the animal to encode a variant of ANGE, CLLD7 or CLLD8 which results in asthma, atopy, hayfever, eczema, atopic dermatitis or allergic rhinitis. A transgenic non-human animal may be produced that no longer expresses a native ANGE, CLLD7 or CLLD8 gene or any combination of these genes or any particular splice variant of the genes. These animals may be referred to as "knock-out" (Manipulating The Mouse Embryo—A Laboratory Manual, Hogan et al 1986). In some cases, it may be desirable to modulate the expression of the foreign nucleic acid and/or the native gene in a temporal or spatial manner. This approach removes viability problems if the expression of the native gene is abolished in all tissues.

In a most preferred embodiment, there is provided a transgenic mouse comprising a nucleic acid encoding a variant form of ANGE, CLLD7 or CLLD8 or any combination of these genes or any splice variant of the genes which causes asthma, atopy, hayfever, eczema, atopic dermatitis or allergic rhinitis or non-atopic asthma. Most preferably, the nucleic acid molecule comprises a SNP at the position which corresponds one or more as shown in Table 2c, or to Position 185752b4_2 Position 185752b5_3 and/or Position 4321017b38_1 of FIG. 5*a*.

Preferably, the mouse is modulated so that it no longer expresses the ANGE, CLLD7 or the CLLD8 gene or any combination of two or more of these genes or any splice variant of the genes in a temporally and/or spatially appropriate manner using homologous recombination techniques or alternatively to over express the ANGE, CLLD7 or CLLD8 gene or any combination of two or more of these genes or any splice variant of the genes to produce a protein as a result of transgenic manipulation.

If a functional polymorphism as shown in Table 4c in the ANGE e.g. ANGE1X3C148T, CLLD7 e.g. CL0703 or CLLD8 gene or any combination of two or more of these genes or any splice variant of the genes is identified (i.e. a "mutation") a construct containing this polymorphism can be introduced into the mouse germ line (i.e. a knock-in) to produce a pathological variant of a protein rather than knocking it out. Alternatively a pathological variant of the ANGE, CLLD7 or CLLD8 gene or any combination of these genes or any splice variant of the genes may be overexpressed.

In the context of the present invention, atopic diseases include those resulting from overexpression of the ANGE, CLLD7 or CLLD8 gene or any combination of these genes or any splice variant of the genes, or the presence of a variant form of the ANGE, CLLD7 or CLLD8 gene or any combination of these variant genes or any splice variant of the variant genes. Specifically, such diseases include asthma (atopic and non-atopic), atopy, hayfever, eczema, atopic dermatitis or allergic rhinitis.

In a sixteenth aspect of the present invention, there is provided a method of diagnosing, or determining predisposition or susceptibility of a subject to atopy or predicting severity of disease in an individual. The method may comprise determining the presence of a variant form of the ANGE, CLLD7 or CLLD8 gene or any combination of these genes or any splice variant of the genes which is known to be associated with a disease state, or measuring the levels of the ANGE, CLLD7 or CLLD8 gene or any combination of these genes or any splice variant of the genes. A variant form of ANGE, CLLD7 or CLLD8 or any combination of at least two of these genes or any splice variant of the genes includes both nucleic acid and amino acid variants. A variant includes any SNP producing an alteration from the wild-type (e.g. for humans) (FIG. 5a/Table 1) or other mutation or alteration from the wild-type.

For example, probes or primers as described above may be useful in detecting nucleic acid encoding ANGE, CLLD7 or CLLD8 or any combination of these genes or any splice variant of the genes or a variant thereof. Information regarding the expression pattern or forms of ANGE, CLLD7 or CLLD8 or any combination of these genes or any splice variant of the genes present will be useful in determining whether the individual is susceptible to diseases, resulting from altered expression of ANGE, CLLD7 or CLLD8 or any combination of these genes or any splice variant of the genes.

In a preferred embodiment, the method may additionally, or alternatively, comprise determining the presence or absence of a risk allele which is associated with one or more of the SNP markers of Table 1, where presence of a risk allele is indicative of disease or predisposition to disease or severity of disease. The method may also comprise genotyping one or more known polymorphisms. Any combination of such polymorphisms may be genotyped. Optionally any one or more SNPs in linkage disequilibrium may be used in the method.

The SNPs of the invention are listed in Table 1 where the nature of the polymorphism is described in the format wild type allele/variant allele. The SNPs are positioned with respect to FIG. 5a, where nucleotide position 1 is the 1$^{st}$ nucleotide in the FIG. 5a.

The alleles for the remaining SNPs identified in the present invention are described in Table 1.

Any technique, including those known to persons skilled in the art, may be used in the above method. These may include the use of probes or primers as described above, or antibodies of the eleventh aspect, for example in ELISA assays or in immunolocalisation. Preferably, the method comprises first removing a sample from a subject. More preferably, the method comprises isolating from a sample a nucleic acid or a polypeptide sequence.

In particular, methods for use in this aspect include those known to persons skilled in the art for identifying differences between nucleic acid sequences, for example direct probing, allele specific hybridisation, PCR methodology including Pyrosequencing (Ahmadian A, Gharizadeh B, Gustafsson A C, Sterky F, Nyren P, Uhlen M, Lundeberg J. Single-nucleotide polymorphism analysis by pyrosequencing, Anal Biochem. 2000 Apr. 10; 280(1):103-10; Nordstrom T, Ronaghi M, Forsberg L, de Faire U, Morgenstern R, Nyren P. Direct analysis of single-nucleotide polymorphism on double-stranded DNA by pyrosequencing. Biotechnol Appl Biochem. 2000 Apr.; 31 (Pt 2):107-12) Allele Specific Amplification (ASA) (WO93/22456), Allele Specific Hybridisation, single base extension (U.S. Pat. No. 4,656,127), ARMS-PCR, Taqman™ (U.S. Pat. Nos. 4,683,202; 4,683,195; and 4,965,188), oligo ligation assays, single-strand conformational analysis ((SSCP) Orita et al PNAS 86 2766-2770 (1989)), Genetic Bit Analysis (WO 92/15712) and RFLP direct sequencing, mass-spectrometry (MALDI-TOF) and DNA arrays. The appropriate restriction enzyme, will, of course, be dependent upon the polymorphism and restriction site, and will include those known to persons skilled in the art. Analysis of the digested fragments may be performed using any method in the art, for example gel analysis, or southern blots.

There is provided a method of diagnosing, or determining predisposition to disease or severity of disease, comprising determining the presence or absence of an allele of a SNP at e.g. as shown in Table 2c, or at position 185752b4_2, 185752b5_2 and/or 4321017b38_1 of FIG. 5a wherein presence of a risk allele is diagnostic of disease or predisposition to disease or severity of disease.

The present invention is advantageous in that it facilitates the accurate diagnosis of disease, or the determination of predisposition to disease or the severity of disease. Thus, by genotyping, an individual may be identified as having or being predisposed to disease and the likely severity of the disease. This helps to identify those individuals who are likely to respond positively to particular treatments or preventative measures. Thus, more effective therapies or preventative measures can be administered.

The diseases, which are associated with the polymorphisms of the invention, include atopic diseases, such as asthma, atopy, hayfever, eczema, atopic dermatitis or allergic rhinitis and non-atopic asthma. Predisposition to disease in the context of the present invention means that these individuals are at higher risk of developing the disease, or a more severe form of the disease, or a particular form of the disease.

In the context of the present invention, a risk allele is the allele of a polymorphism, which is associated with disease or predisposition to disease. The risk allele may be the wild type or the variant allele, as defined below.

The term "polymorphism" refers to the coexistence of multiple forms of a sequence. Thus, a polymorphic site is the location at which sequence divergence occurs. The different forms of the sequence, which exist as a result of the presence of a polymorphism, are referred to as "alleles". The region comprising a polymorphic site may be referred to as a polymorphic region.

Examples of the ways in which polymorphisms are manifested include restriction fragment length polymorphisms (Botstein et al Am J Hum Genet 32 314-331 (1980)), variable number of tandem repeats, hypervariable regions, minisatellites, di- or multi-nucleotide repeats, insertion elements and nucleotide or amino acid deletions, additions or substitutions. A polymorphic site may be as small as one base pair, which may alter a codon thus resulting in a change in the encoded amino acid sequence.

Single nucleotide polymorphisms arise due to the substitution, deletion or insertion of a nucleotide residue at a polymorphic site. Such variations are referred to as SNPs. SNPs may occur in protein coding regions, in which case different polymorphic forms of the sequence may give rise to variant protein sequences. Other SNPs may occur in non-coding regions. In either case, SNPs may result in defective proteins or regulation of genes, thus resulting in disease. Other SNPs may have no phenotypic effects, but may show linkage to disease states, thus serving as markers for disease. SNPs typically occur more frequently throughout the genome than other forms of polymorphism discussed above, and there is therefore a greater probability of finding a SNP associated with a particular disease state.

Linkage disequilibrium is the co-inheritance of two alleles at greater frequencies than would be expected from the separate frequencies of each allele. Conversely, alleles are in linkage equilibrium if they occur together. The expected frequency of two alleles inherited together is the product of the frequency of each allele.

Also provided is a method diagnosing an individual as having abnormal serum IgE levels, the method comprising demonstrating in the individual the presence or absence of an allele which is associated with the SNP marker 185752b4_2 and optionally any other SNP in linkage disequilibrium with the marker and a method for diagnosing an individual as having an STI above 5 mm, the method comprising demonstrating in the individual the presence or absence of an allele which is associated with the SNP marker 4321017b38_1 and optionally any other SNP in linkage disequilibrium with the marker.

Where two or more polymorphisms are genotyped, the method preferably defines determining the presence or absence of a haplotype, which is indicative of disease or predisposition to disease. A haplotype is defined herein as a collection of polymorphic sites in a particular sequence that are inherited in a group, i.e. are in linkage disequilibrium with each other. The identification of haplotypes in the diagnosis of disease helps to reduce the possibility of false positives. The haplotype may be any particular combination of polymorphisms of Table 1, optionally in combination with one or more known polymorphisms. A preferred haplotype is the combination of SNPs as shown in Table 2c; or positions 185752b4_2, 185752b5_3 and 4321017b38_1 of FIG. 5a.

A method for diagnosing an individual as being atopic, the method comprising demonstrating in an individual the presence or absence of alleles associated with the haplotype as shown in Table 2c or the haplotype 185752b4_2, 185752b5_3, 4321031b43_1 and optionally any other SNP in linkage disequilibrium with any one of these markers is also provided.

The methods of the sixteenth aspect are preferably carried out on a sample removed from a subject. Any biological sample comprising cells containing nucleic acid, preferably that of FIG. 5a, is suitable for this purpose. Examples of suitable samples include whole blood, leukocytes, semen, saliva, tears, buccal, skin or hair. For analysis of DNA, mRNA or protein, the sample must come from a tissue in which the sequence of interest is expressed. Blood is a readily accessible sample. Thus, the method of the sixteenth aspect preferably includes the steps of obtaining a sample from an individual, preparing nucleic acid and/or protein from the sample and analysing the nucleic acid or protein sample for the presence or absence of a particular allele or gene or combination of genes of interest or a particular splice variant. Where nucleic acid is to be analysed, it is preferred that an amplification step be performed prior to analysis. A preferred amplification technique is PCR, although any other suitable methods may be employed. Preferably the method uses a pair of primers which hybridise under stringent conditions to a region either side of a SNP. The primers may include an oligonucleotide sequence as shown in Table 4.

The subject is preferably a mammal, and more preferably a human. The subject may be an infant, a child or an adult. Alternatively, the sample may be obtained from the subject prepartum e.g. by amniocentesis.

A subject's risk factor for disease may be determined with reference also to other known genetic factors, and/or clinical, physiological or dietary factors.

The above described methods may require amplification of the DNA sample from the subject, and this can be done by techniques known in the art, such as PCR (see *PCR Technology: Principles and Applications for DNA Amplification* (ed. H. A. Erlich, Freeman Press, NY 1992; *PCR Protocols: A Guide to methods and Applications* (eds. Innis et al., Academic press, San Diego, Calif. 1990); Mattila et al., *Nucleic Acids Res.* 19 4967 (1991); Eckert et al., *PCR Methods and Applications* 117 (1991) and U.S. Pat. No. 4,683,202. Other suitable amplification methods include ligase chain reaction (LCR) (Wu et al., *Genomics* 4 560 (1989); Landegran et al., *Science* 241 1077 (1988)), transcription amplification (Kwoh et al., *Proc Natl Acad Sci USA* 86 1173 (1989)), self sustained sequence replication (Guatelli et al., *Proc Natl Acad Sci USA* 87 1874 (1990)) and nucleic acid based sequence amplification (NASBA). The latter two methods both involve isothermal reactions based on isothermal transcription which produce both single stranded RNA and double stranded DNA as the amplification products, in a ratio of 30 or 100 to 1, respectively.

Where it is desirable to analyse multiple samples simultaneously, it may be preferable to use arrays as described in WO95/11995. The array may contain a number of probes, each designed to identify variants of the ANGE, CLLD7 or CLLD8 genes or any combination of two or more of these genes or any splice variant of the genes from a sample.

Where a restriction enzyme is required, it can be selected according to the nature of the polymorphism and restriction site. Suitable enzymes will be known to persons skilled in the art. Analysis of the digested fragments may be performed using any method in the art, for example gel analysis, or Southern blots.

Determination of an allele of a polymorphism using the above methods typically involves the use of anti-sense sequences i.e. sequences which are complementary to the nucleic acid sequences of interest, which may include part of the sequence of FIG. 5a. Such sequences are described in the first to eighth aspects of the invention.

Where it is desirable to identify the presence of multiple single nucleotide polymorphisms, or haplotypes, in a sample from a subject, it may be preferable to use an array. The array may contain a number of probes, each designed to identify one or more of the above single nucleotide polymorphisms of the invention.

An antibody to the ANGE, CLLD7 or CLLD8 genes or any combination of these genes, or the presence or absence of any splice variant of the genes as previously described may be used in the method of the sixteenth aspect. The detection of binding of the antibody to the antigen in a sample may be assisted by methods known in the art, such as the use of a secondary antibody, which binds to the first antibody, or a ligand. Immunoassays including immunofluorescence assays (IFA) and enzyme linked immunosorbent assays (ELISA) and immunoblotting may be used to detect the presence of the antigen. For example, where ELISA is used, the method may comprise binding the antibody to a substrate, contacting the bound antibody with the sample containing the antigen, contacting the above with a second antibody bound to a detectable moiety (typically an enzyme such as horse radish peroxidase or alkaline phosphatase), contacting the above with a substrate for the enzyme, and finally observing the colour change which is indicative of the presence of the antigen in the sample.

Any biological sample comprising cells containing nucleic acid or protein is suitable for this purpose. Examples of suitable samples include whole blood, semen, saliva, tears, buccal, skin or hair. For analysis of cDNA, mRNA or protein, the sample must come from a tissue in which the ANGE, CLLD7 or CLLD8 genes or any combination of two or more of these genes or any splice variant of the genes is expressed. Peripheral blood leukocytes are a readily accessible sample.

In a seventeenth aspect of the invention, there is provided a splice variant of ANGE, CLLD8 or CLLD7 for use in a method of diagnosing an IgE mediated disease, atopy, or a form of atopic disease or non-atopic asthma, or predicting severity of disease, or predisposition to disease.

The splice variant is preferably an RNA, more preferably a mRNA sequence, encoded by the whole or part of the sequence of ANGE or CLLD8 or CLLD7. Transcripts of the ANGE gene and splice variants of the ANGE gene are included as a further aspect of the invention. The splice variants of the seventeenth aspect include at least one exon, or fragment of an exon of ANGE, CLLD8 or CLLD7, or a combination of at least one exon, or fragment of an exon, from at least two of the ANGE, CLLD8 and CLLD7 genes. In particular, the splice variants of ANGE may include transcripts having AB011031 exon 1 or AF155105 exon 1; or comprising at least exon 2; lacking exon 2; comprising at least exon Va or Vb which lies between exons 5 and 6 (FIG. 4G); lacking exon Va or Vb; comprising at least exon 4, 5, 6, 7 and/or 8. The intron/exon map of ANGE is shown in FIG. 3.

In an eighteenth aspect, there are provided the use of a splice variant of ANGE and/or CLLD8 and/or CLLD7 in the manufacture of a diagnostic for use in a method of diagnosing atopy or a form of atopic disease, or predicting severity of disease, or predisposition to disease. Alternatively, the splice variant is provided for use in the manufacture of a medicament for treating disease or for use in a method of treating disease.

In a nineteenth aspect, there is provided a kit comprising a splice variant according to the seventeenth aspect for use in a method according to the sixteenth aspect. Preferably, two or more splice variants are provided, preferably in the form of an array, or on a chip.

In a twentieth aspect, there is provided a polynucleotide sequence comprising the ANGE, CLLD8 or CLLD7 genes, or a polypeptide encoded by the sequence, or fragment thereof, for use in a screen for an agent which inhibits or enhances the activity of ANGE, CLLD8 or CLLD7. Methods of screening for such agents are also provided.

In a twenty-first aspect of the invention there is provided a kit for diagnosis of disease or predisposition to disease, comprising a means for determining the presence or absence of a allele of a SNP of Table 1, wherein the allele is diagnostic of disease, or of predisposition to disease, or of severity of disease.

In a preferred embodiment, the kit comprises a means for determining the presence or absence of one or more risk alleles of polymorphisms according to the eighth aspect. In particular, the kit comprises means for determining the presence or absence of a risk allele of a SNP as shown in Table 2c; or at at position 185752b4__2, position 185752b5__3, and/or position 4321017b38__1 of FIG. 5a.

Preferably the kit will comprise the components necessary to determine the presence or absence of a risk allele of the eighth aspect, in accordance with the sixteenth aspect of the invention. Such components include PCR primers and/or probes, for example those described above, PCR enzymes, restriction enzymes, and DNA or RNA purification means. Preferably, the kit will contain at least one pair of primers, or probes, preferably as described above in accordance with the eighth aspect of the invention. The primers are preferably allele specific primers. Other components include labelling means, buffers for the reactions. In addition, a control nucleic acid sample may be included, which comprises a wild type or variant nucleic acid sequence as defined above, or a PCR product of the same. The kit will usually also comprise instructions for carrying out the diagnostic method, and a key detailing the correlation between the results and the likelihood of disease. The kit may also comprise an agent for the prevention or treatment of disease.

In a twenty-second aspect of the invention, there is provided a method of identifying a compound for treatment of disease, comprising (a) administration of a compound to tissue comprising a nucleic acid molecule comprising one or more SNPs at positions which correspond to a positions of FIG. 5a listed in Table 1; and (b) determining whether the agent modulates an effect of the SNPs.

In a preferred embodiment, the isolated nucleic acid molecule is according to the eighth aspect of the invention, and most preferably comprises a SNP as shown in Table 2c; or at a position corresponding to position 185752b4__2 and/or position 185752b5__3, and/or position 4321017b38__1 of FIG. 5a.

In this aspect, a nucleic acid molecule of the invention, and/or a cell line according to an aforementioned aspect, may be used to screen for agents, which are capable of modulating the effect of a SNP.

Potential agents are those which react differently with a risk allele and non-risk allele. Putative agents will include those known to persons skilled in the art, and include chemical or biological compounds, sense or anti-sense nucleic acid sequence for example as described above, binding proteins, kinases, and any other gene or gene product, agonist or antagonist. Preferably, the agent will be capable of modulating the effects of the disease causing allele. Most preferably, the agent is one which is capable of ameliorating the deleterious effects of the risk allele.

Such agents may be suitable for either prophylactic administration or after a disease has been diagnosed. The route of administration is suitably chosen according to the disease or condition to be treated, however, typical routes of administration of the agent of the present invention include but are not limited to oral, rectal, intravenous, parenteral, intramuscular and sub-cutaneous routes. The invention also provides for agents to be administered either as DNA or RNA and thus as a form of gene therapy. The agents may be delivered into cells directly by means including but not limited to liposomes, viral vectors and coated particles (gene gun).

In a twenty-third aspect of the present invention there is provided an agent or antibody as described above according to the invention, for use in preventing or treating an IgE mediated disease such as asthma, atopy, hayfever, eczema, atopic dermatitis or allergic rhinitis or non-atopic asthma.

There is also provided an agent capable of influencing expression of the ANGE and/or CLLD8 and/or CLLD7 genes for use in a method of treating an IgE-mediated disease e.g. atopy or non-atopic asthma in an individual. Preferably, the agent is capable of influencing the activity of the ANGE and/or CLLD8 and/or CLLD7 gene promoters and/or influencing RNA splicing of the ANGE and/or CLLD8 and/or CLLD7 or ANGE and CLLD7 genes or any combination of two or more of the genes or of any splice variant. Influencing or modulating the activity may include either inhibiting or enhancing, or altering the pattern of activity. Examples of agents according to the twenty-third aspect include but are not limited to proteins, such as transcription factors, which may bind to the ANGE/CLLD8 promoter or splice sites; antibodies or binding partners; ribozymes; and polynucleotide sequences.

Preferred agents for influencing the expression of the genes include polynucleotide sequences, which are complementary to the relevant polynucleotide sequence of FIG. 5a. Sequence complementarity can be determined using conventional techniques available in the art. Preferred complementary, or antisense, sequences are those which hybridise under stringent conditions to the genes. Suitably stringent conditions are those under which non-specific hybridisation (e.g. to non-ANGE sequences) are avoided.

In relation to the present invention, "stringent conditions" refers to the washing conditions used in a hybridisation protocol. In general, the washing conditions should be a combination of temperature and salt concentration so that the denaturation temperature is approximately 5 to 20° C. below the calculated $T_m$ of the nucleic acid under study. The $T_m$ of a nucleic acid probe of 20 bases or less is calculated under standard conditions (1M NaCl) as [4° C.×(G+C)+2° C.×(A+T)], according to Wallace rules for short oligonucleotides. For longer DNA fragments, the nearest neighbour method, which combines solid thermodynamics and experimental data may be used, according to the principles set out in Breslauer et al., PNAS 83: 3746-3750 (1986). The optimum salt and temperature conditions for hybridisation may be readily determined in preliminary experiments in which DNA samples immobilised on filters are hybridised to the probe of interest and then washed under conditions of different stringencies. While the conditions for PCR may differ from the standard conditions, the $T_m$ may be used as a guide for the expected relative stability of the primers. For short primers of approximately 14 nucleotides, low annealing temperatures of around 44° C. to 50° C. are used. The temperature may be higher depending upon the base composition of the primer sequence used.

Antisense sequences which hybridise under stringent conditions to the ANGE or CLLD8 or CLLD7 genes may be useful as primers in any of the aspects of the present invention. Pairs of primers for amplification of all or part of the ANGE, CLLD8 or CLLD7 genes, or alleles, or variants thereof, form another aspect of the invention.

There is also provided the use of an agent or antibody as described above in the manufacture of a medicament for use in preventing or treating an IgE mediated disease such as asthma, atopy, hayfever, eczema, atopic dermatitis or allergic rhinitis or non-atopic asthma. The agents of the above aspect, in particular antisense sequences, may also be useful in diagnosing an individual as having atopy.

According to a twenty-fourth aspect of the invention, there is provided, a pharmaceutical composition or medicament comprising a nucleic acid or polypeptide sequence as defined above according to the invention. Alternatively, the pharmaceutical composition may comprise an agent as defined in relation to the above aspect or an antibody according to the eleventh aspect of the invention.

Administration of pharmaceutical compositions is accomplished by any effective route, e.g. orally or parenterally. Methods of parental delivery include topical, intra-arterial, subcutaneous, intramedullary, intravenous, or intranasal administration. Administration can also be effected by amniocentesis-related techniques. Oral administration followed by subcutaneous injection would be the preferred routes of uptake; also long acting immobilisations would be used. In addition to the active ingredients, these pharmaceutical compositions may contain suitable pharmaceutically acceptable carriers comprising excipients and other compounds that facilitate processing of the active compounds into preparations which can be used pharmaceutically. Further details on techniques for formulation and administration may be found in the latest edition of "REMINGTON'S PHARMACEUTICAL SCIENCES" (Maack Publishing Co, Easton Pa.).

Pharmaceutical compositions for oral administration can be formulated using pharmaceutically acceptable carriers well known in the art, in dosages suitable for oral administration. Such carriers enable the pharmaceutical compositions to be formulated as tablets, pills, dragees, capsules, liquids, gels, syrups, slurries, suspensions, etc., suitable for ingestion by the patient.

Pharmaceutical compositions suitable for use in the present invention include compositions wherein the active ingredients are contained in an effective amount to achieve the intended purpose. Thus, a therapeutically effective amount is an amount sufficient to ameliorate or eradicate the symptoms of the disease being treated. The amount actually administered will be dependent upon the individual to which treatment is to be applied, and will preferably be an optimised amount such that the desired effect is achieved without significant side-effects. The determination of a therapeutically effective dose is well within the capability of those skilled in the art. Of course, the skilled person will realise that divided and partial doses are also within the scope of the invention.

For any compound, the therapeutically effective dose can be estimated initially either in cell culture assays or in any appropriate animal model. These assays should take into account receptor activity as well as downstream processing activity. The animal model is also used to achieve a desirable concentration range and route of administration. Such information can then be used to determine useful doses and routes for administration in humans.

A therapeutically effective amount refers to that amount of agent, which ameliorates the symptoms or condition. Therapeutic efficacy and toxicity of such compounds can be determined by standard pharmaceutical procedures, in cell cultures or experimental animals (e.g. $ED_{50}$, the dose therapeutically effective in 50% of the population; and $LD_{50}$, the dose lethal to 50% of the population). The dose ratio between therapeutic and toxic effects is the therapeutic index, and it can be expressed as the ratio $ED_{50}/LD_{50}$. Pharmaceutical compositions, which exhibit large therapeutic indices, are preferred. The data obtained from cell culture assays and animal studies is used in formulating a range of dosage for human use. The dosage of such compounds lies preferably within a range of circulating concentrations that include the $ED_{50}$ with little or no toxicity. The dosage varies within this range depending upon the dosage form employed, sensitivity of the patient, and the route of administration.

The exact dosage is chosen by the individual physician in view of the patient to be treated. Dosage and administration are adjusted to provide sufficient levels of the active moiety or to maintain the desired effect. Additional factors, which may be taken into account, include the severity of the disease state. Long acting pharmaceutical compositions might be administered every 3 to 4 days, every week, or once every two weeks depending on half-life and clearance rate of the particular formulation. Guidance as to particular dosages and methods of delivery is provided in the literature (see, U.S. Pat. Nos. 4,657,760; 5,206,344 and 5,225,212 herein incorporated by reference).

According to a twenty-fifth aspect of the invention, there is provided a method of preventing or treating disease in a subject comprising modulating the activity, expression, half life or post-translational modification of ANGE and/or CLLD7 and/or CLLD8 or any combination of two or more of these genes or any splice variant of the genes in the subject.

In addition, the treatment of individuals having an IgE mediated disease or non-atopic asthma includes prevention of atopy, and prophylactic and therapeutic measures.

Preferably, the method is carried out in a subject who has been diagnosed as suffering from, or is susceptible to IgE mediated diseases such as asthma, atopy, hayfever, eczema, atopic dermatitis or allergic rhinitis, or non-atopic asthma.

Preferably, the method comprises determining the presence or absence of a risk allele of a SNP such as one which has an association with IgE mediated disease e.g. at position 185752b4_2, 185752b5_3 and/or 4321017b38_1 of FIG. 5a or which has an association with asthma, atopy or a combination thereof e.g. as shown in Table 2c; and if the risk allele is present, administering treatment in order to prevent, delay or reduce the disease.

Preferably, the step of determining the presence or absence of a risk allele is carried out in accordance with the sixteenth aspect, and therefore also comprises determining the presence or absence of risk alleles of SNPs of Table 1, or any combination thereof, for example as described above.

There is also provided a method of preventing or treating an IgE mediated disease or of non-atopic asthma in an individual, the method comprising modulating the expression of the CLLD8 and/or ANGE and/or CLLD7 genes or any combination of two or more of the genes or of any splice variant of the genes. Preferably, the method modulates the production of a gene product according to the first to eighth aspects of the invention. In particular, the twenty-fifth aspect may be achieved by modulating the activity of the CLLD8 promoter, or modulating the splicing of the CLLD8 and/or ANGE genes.

By modulating or influencing is meant inhibiting, enhancing or otherwise altering the expression.

The prevention or treatment of disease according to the twenty-fifth aspect may include the administration of any agent capable of modulating the effects of the ANGE, CLLD7 or CLLD8 genes or any combination of two or more of these genes or fragments of these genes or any splice variant of the genes or of an allele which has an association with disease. Preferably, the agent is one which is capable of ameliorating the deleterious effects of the risk allele. The methods include, but are not limited to, gene therapy techniques. Gene therapy techniques typically involve replacing the nucleic acid sequence comprising the risk allele, or otherwise down regulating the effects of the risk allele. The nucleic acid sequences of the first to eighth aspect, or sequences anti-sense thereto, will be useful in gene therapy.

By modulating is meant inhibiting or increasing the activity of the gene or gene product. Preferably, the activity is inhibited. The activity of the gene or gene product includes any aspect of its production or function, including transcription and translation of nucleic acid sequences, and assembly of the protein, post-translational modification of the protein and downstream interactions with other factors.

The activity of the ANGE, CLLD7 or CLLD8 gene or any combination of two or more of these genes or any splice variant of the genes can be modulated in a number of ways. For example, the expression of the gene may be inhibited through the use of antisense sequences, such as those of the first to eighth aspects of the invention or by the production of antisense RNA sequences. Such sequences when introduced into a subject by gene therapy will hybridise to the ANGE, CLLD7 or CLLD8 gene or to any transcript which is a combination of two or more of these genes or to any splice variant of the genes or to RNA transcribed from the gene or genes, and inhibit its transcription or translation. This method may be particularly useful where it is desirable to modulate the function or expression of certain splice variants of ANGE, CLLD7 or CLLD8 or certain combinations of these genes whilst not affecting others.

Introduction of a nucleic acid sequence may use gene therapy methods including those known in the art. In general, a nucleic acid sequence will be introduced into the target cells of a subject, usually in the form of a vector and preferably in the form of a pharmaceutically acceptable carrier. Any suitable delivery vehicle may be used, including viral vectors, such as retroviral vector systems, which can package a recombinant genome. The retrovirus could then be used to infect and deliver the polynucleotide to the target cells. Other delivery techniques are also widely available, including the use of adenoviral vectors, adeno-associated vectors, lentiviral vectors, pseudotyped retroviral vectors and pox or vaccinia virus vectors. Liposomes may also be used, including commercially available liposome preparations such as Lipofectin®, Lipofectamine®, (GIBCO-BRL, Inc. Gaitherburg, Md.), Superfect® (Qiagen Inc, Hilden, Germany) and Transfectam® (Promega Biotec Inc, Madison Wis.).

Other means to modulate a biological activity of the ANGE, CLLD7 or CLLD8 gene or any combination of two or more of these genes or any splice variant of the genes includes using agents which may affect interaction of ANGE, CLLD7 or CLLD8 or any combination of two or more of these genes or any splice variant of the genes with downstream factors with which they interact.

Also provided is an agent capable of influencing expression of the ANGE, CLLD8 or CLLD7 gene, for use in a method of preventing or treating an IgE mediated disease or non-atopic asthma in an individual. Preferably the agent is capable of influencing the activity of the ANGE, CLLD8 or CLLD7 gene promoters or of any combination of two or more of the gene promoters. Preferably the agent is capable of influencing RNA splicing of the ANGE, CLLD8 or CLLD7 gene or of any combination of two or more of the transcripts of the genes. Agents include nucleic acid sequences of the first to eighth aspects, polypeptide sequences of the tenth aspect, antibodies of the eleventh aspect, and any other agent defined herein, preferably those which are capable of modulating the activity of ANGE, CLLD7 or CLLD8 or any combination of two or more of these genes or any splice variant of the genes.

The subject may be any animal, preferably a mammal, and more preferably human.

Also provided is the use of an agent as defined above in the manufacture of a medicament for use in the prevention or treatment of an IgE mediated disease or non-atopic asthma, as defined above, in a subject.

According to a twenty-sixth aspect of the invention, there is provided a number of screens. A first screen provides for identifying an agent, which modulates the activity of the ANGE, CLLD7 or CLLD8 gene or any combination of two or more of these genes or any splice variant of the genes comprising:

providing a polypeptide sequence as claimed in the tenth aspect of the invention;
providing a substrate;
providing an agent to be tested;
measuring whether the agent to be tested modulates the activity of the polypeptide by measuring processing of the substrate.

The components of the screen are combined, in any optional order, more than 1 substrate or polypeptide may be included in the assay.

In the screening assay the polypeptide may be any polypeptide according to the tenth aspect of the invention. Fragments of the ANGE, CLLD7 or CLLD8 genes or any combination of two or more of the genes or any splice variant of the genes may be used. Also, the ANGE, CLLD7 or CLLD8 genes or any combination of these genes or any splice variant of the genes which comprise one or more SNP nucleic acid sequences of the present invention, such as described in the first to eighth aspects may be used. The polypeptide may be purified or non-purified. The polypeptide may be soluble. It may comprise one or more of the domains.

The agent being tested is being identified for use in the prevention or treatment of an IgE mediated disease or disorder or in non-atopic asthma. IgE mediated diseases or disorders include: asthma, atopy, hayfever, eczema, atopic dermatitis or allergic rhinitis.

The substrate may be any which is processed by a polypeptide according to the tenth aspect of the invention. By processed is meant any changes which can be measured. These substrates may be fluorescently labelled or modified to allow easy detection of processing. Such labelling or modification is known to the person skilled in the art.

In a preferred embodiment, the assay is any means of measuring histone methyl transferase activity or nucleotide exchange factor activity known to the person skilled in the art. For example Hama et al J. Biol. Chem., 274: 15284-15291 1999.

The present invention further provides a screen for identifying an agent which modulates the activity of the ANGE, CLLD7 or CLLD8 genes or any combination of two or more of these genes or any splice variant of the genes comprising:

providing a polypeptide according to the tenth aspect of the invention;

providing an agent to be tested;

providing a cell; and measuring whether the agent to be tested modulates the activity of the polypeptide by measuring adhesion of the cell to a surface.

Such a screen can be referred to as a cell adhesion screen (or assay). The components of the screen are combined, in any optional order.

Typically cells used in the cell adhesion assay may be maintained in suspension where adhesion is measured by aggregation of the cells due to intercellular adhesion molecule interactions. Alternatively, adhesion to a surface may be measured. The surface may be a non-biological molecule e.g. tissue culture plastic or it may be a biological molecule, which is cellular or non-cellular. Examples of a non-cellular molecule include extracellular matrix components such as fibronectin, collagen and such like. One or more cells or other biological non-cellular molecules may be attached to a surface such as a tissue culture surface or an extracellular matrix component-coated surface. Adhesion is determined by measuring the adhesion of a cell to a surface. Modulation in cell adhesion may be either an increase in cell adhesion or a decrease in cell adhesion. An agent is considered to be a modulator of the polypeptide of the tenth aspect if it affects the activity or expression of the polypeptide, this may be either at the level of expression of the ANGE, CLLD7 or CLLD8 genes or of the expression of any combination of two or more of the genes or any splice variant of the genes or by altering the half life of any of the ANGE, CLLD7 or CLLD8 mRNA or polypeptide molecules or of any combination of two or more of the genes, or of any splice variant of the genes or by affecting the post-translation modification status of the ANGE, CLLD7 or CLLD8 polypeptides or the polypeptide encoded by any combination of two or more of these genes or the polypeptide encoded by any splice variant of the genes.

The cell may be the host cell of the fourteenth aspect of the invention comprising the vector of the ninth aspect. The twenty-sixth aspect also includes the use of the host cell in screens to identify an agent.

Yet a further aspect of the invention provides a screen for identifying an agent which modulates the activity of the ANGE, CLLD7 or CLLD8 genes or the activity of any combination of two or more of the genes or the activity of any splice variant of the genes comprising:

providing a polypeptide according to the tenth aspect of the invention;

providing an agent to be tested;

providing a cell;

measuring a change in differentiation or proliferation of the cell.

The components of the screen are combined, in any optional order.

Typically, differentiation may be measured by any means known to the persons skilled in the art for example in the case of a B-lymphocyte, the change in differentiation can be B-cell activation. The cell may express one or more of the polypeptides of the tenth aspect or be the host cell of the fourteenth aspect. In the case of other cell types it may be the induction or prevention of production of a cell signalling factor such as an immunomodulator e.g. a cytokine or growth factor. The cell signalling factor may be secreted. The immunomodulator may be a peptide regulatory factor or may be any other biological substance which expression is altered by an agent which modulates the ANGE, CLLD7 or CLLD8 gene or any combination of two or more of these genes or any splice variant of the genes. Typically this assay is performed in vitro for example in tissue or organ culture and the cell may be cultured following removal from a patient or animal or the transgenic animal of the fifteenth aspect.

The change in phenotype may be any. It may involve a change in B-cell phenotype.

Such a screen provides an in vitro model for identifying an agent which modulates the activity of the ANGE, CLLD7 or CLLD8 gene or any combination of two or more of these genes or any splice variant of the genes.

Yet a further aspect of the invention provides a screen for identifying an agent which modulates the activity of the ANGE, CLLD7 or the CLLD8 gene or any combination of two or more of the genes or any splice variant of the genes comprising:

providing a transgenic animal according to the fifteenth aspect of the invention;

providing an agent to be tested;

contacting the transgenic animal with the agent to be tested;

detecting a change in the transgenic animals phenotype.

The components of the screen are combined, in any optional order.

The cell against which the agent is tested may be in suspension, tissue culture, as part of an organ or as part of an animal. Preferably the animal is a laboratory animal, such as a rat, rabbit, mouse or other rodent.

A change in phenotype includes a change in gene expression or in the production of RNA or protein or in cell morphology or behaviour.

Yet a further aspect of the invention provides a screen for detecting a side effect associated with the use of an agent which modulates the activity of the ANGE, CLLD7 or CLLD8 gene or any combination of two or more of the genes or any splice variant of the genes comprising:

providing a cell which does not substantially express the nucleic acid sequence of the first to eighth aspects of the invention or the polypeptide of the tenth aspect of the invention;

providing an agent to be tested;

contacting the agent to be tested with the cell; and measuring any side effect produced by the agent on the cell.

The components of the screen are combined, in any optional order.

The side effect to be measured may be any, and may depend on whether the cell is part of a larger tissue or animal. It may involve a change in cell differentiation, or cell proliferation. The side effect may be a measure of the change of phenotype of an organ or animal.

Yet a further aspect of the invention provides a screen for identifying an agent which modulates the activity of a polynucleotide according to the first to eighth aspects of the invention or a polypeptide according to the tenth aspect of the invention comprising:

providing an isolated nucleic acid according to the first to eighth aspects of the invention or a polypeptide according to the tenth aspect of the invention;

providing an agent to be tested;

measuring whether the agent to be tested modulates the activity of the isolated nucleic acid or polypeptide by measuring the interaction of the agent with the sample of nucleic acid or polypeptide.

Preferably this screen is an in vitro transcription assay, measuring transcription of the ANGE, CLLD7 or CLLD8 gene or any combination of two or more of these genes or any splice variant of the genes.

Alternatively, an agent may be identified by the use of theoretical or model characteristics of the ANGE, CLLD7 or CLLD8 gene or of a transcript produced by a combination of two or more of these genes or any splice variant of the genes. The functional or structural characteristics may be of the protein itself or of a computer generated model, a physical two- or three-dimensional model or an electrical (e.g. computer) generated primary, secondary or tertiary structure, as well as the pharmacaphore (three dimensional electron density map) or its X ray crystal structure.

Putative agents will include those known to persons skilled in the art or new substances, and include chemical or biological compounds, such as anti-sense nucleotide sequences, polyclonal or monoclonal antibodies which bind to a polypeptide sequence of the tenth aspect.

According to a twenty-seventh aspect of the invention, there is provided the use of a nucleic acid sequence or polypeptide sequence as defined above in a screen for an agent which modulates the activity of the ANGE, CLLD7 or CLLD8 gene or of any combination of two or more of the genes or of any splice variant of the genes.

The method preferably comprises contacting a putative agent with a nucleic acid or polypeptide sequence according to an aforementioned aspect of the present invention and monitoring expression and/or activity of the nucleotide or polypeptide sequence. Potential agents are those which alter the activity or expression of the polynucleotide or polypeptide sequence compared to the activity or expression in the absence of the agent. The present method may be carried out by contacting a putative agent with a host cell, tissue culture, or transgenic non-human animal comprising a nucleotide or polypeptide according to the invention, and displaying inflammatory disease.

Also provided are agents identified by the methods of the twenty-sixth aspect.

Preferred features for the second and subsequent aspects of the invention are as for the first aspect mutatis mutandis.

FIGS. 1a-b show a Linkage Disequilibrium map of the atopy locus.

a) Linkage Disequilibrium map of the Atopy Locus

A GOLD plot[28] of colour coded pair-wise disequilibrium statistics (D') between markers is shown. The locus extends from the bottom left of the figure to the top right. Red and yellow indicate areas of strong LD. LD is approximately divided into four regions. The scale bar at the bottom indicates a distance of 200 Kb.

b) Detail of LD around the ANGE (NY-REN-34) gene complex

Association to IgE levels is shown above the figure. Genes are shown as black arrows, pointing in the direction of transcription. The scale bar at the bottom indicates a distance of 100 Kb FIG. 2 shows the extent of linkage disequilibrium between SNPs on chromosome 13q14.

FIGS. 3a-d:
a) shows the schematic structure of the gene ANGE
b) Detail of structure of ANGE promoter and alternate exons
c) Pile up of transcripts by amplification between alternative Exon I and Exon II (SEQ ID NOs: 2-16)
d) shows transcription of ANGE to immune tissue from alternate Exon 1.

FIGS. 4a-c show splice variation in ANGE.

a) PCR amplification of exons 1-3 in multiple tissue cDNA panels

The presence of a smaller band indicating absence of exon 2 is observed in all tissues b) PCR amplification of exons 4-6 in multiple tissue cDNA panels The presence of additional bands indicating retention of a additional exons (Va and Vb) is observed in lung and immune tissues. The band is present in cDNAs from unactivated lymphocytes, and absent in activated lymphocytes.

c) PCR amplification of exons 7-8 in multiple tissue cDNA panels

The presence of additional bands, indicating retention of exon 7 is observed in lung liver, kidney and pancreas, and immune tissues. The band is most highly expressed in cDNAs from resting T and B cells.

FIG. 5a (SEQ ID NO:1) shows the nucleotide sequence of the ANGE 1 gene (NY-REN-34) as nucleotides 313649-346509 the nucleotide sequence of CLLD8 as nucleotides 294727-309803 and the sequence of CLLD8 as nucleotides 349634-410846 of BAC bA103J18.03548.

FIG. 5b shows the following sequences for the ANGE gene:
(i) Exon sequences (SEQ ID NOs:17-26);
(ii) Protein sequence (SEQ ID NO:27);

FIG. 5c shows the following sequences for the NY-REN-34 gene:
(i) mRNA sequence (SEQ ID NOs:28-37);
(ii) Protein sequence (SEQ ID NO:38);
(iii) Alternative protein sequence (SEQ ID NO:39);

FIG. 5d shows the following sequences for the CLLD7 gene:
(i) Exon sequences (SEQ ID NOs:40-52);
(ii) Protein sequence (SEQ ID NO:53).

FIG. 5e shows the following sequences for the CLLD8 gene:
(i) Exon structure and nucleic acid sequence (SEQ ID NOs54-68);
(ii) Protein sequence (SEQ ID NO:69).

FIG. 6 shows the nucleotide sequence of BAC bA101d11.01116 (SEQ ID NO:70).

FIG. 7 shows the nucleotide sequence of BAC bA236 m15.00303 (SEQ ID NO :71)

Proteins are described in the text. The SET domains of CLLD8 and ESET are bifurcated due to the presence of large insertions. The IL-5 promoter REII-region-binding protein, that arises from an mRNA initiated within a middle intron of the WHSC1/MMSET gene[46], is shown.

Domain symbols: AT, AT-hook DNA-binding motif; B, bromodomain; C (white-on-black), cysteine-rich regions flanking SET domains; C, FYRC domain; $C_5HCH$, zinc finger domain; CpG, methyl-CpG-binding domains; CXXC, CXXC-type zinc finger; HMG, high mobility group domains; N, FYRN domain; P, PHD domains with two (blue rectangle) and one (yellow rectangle) Zn2+ coordinating groups; PW, PWWP domains; SET, Su(var)3-9, Enhancer-of-zeste, trithorax methyltransferase domains; and, T, tudor domains.

FIG. 9 shows co-expression of the CLLD8/ANGE gene complex.

Figure 10:
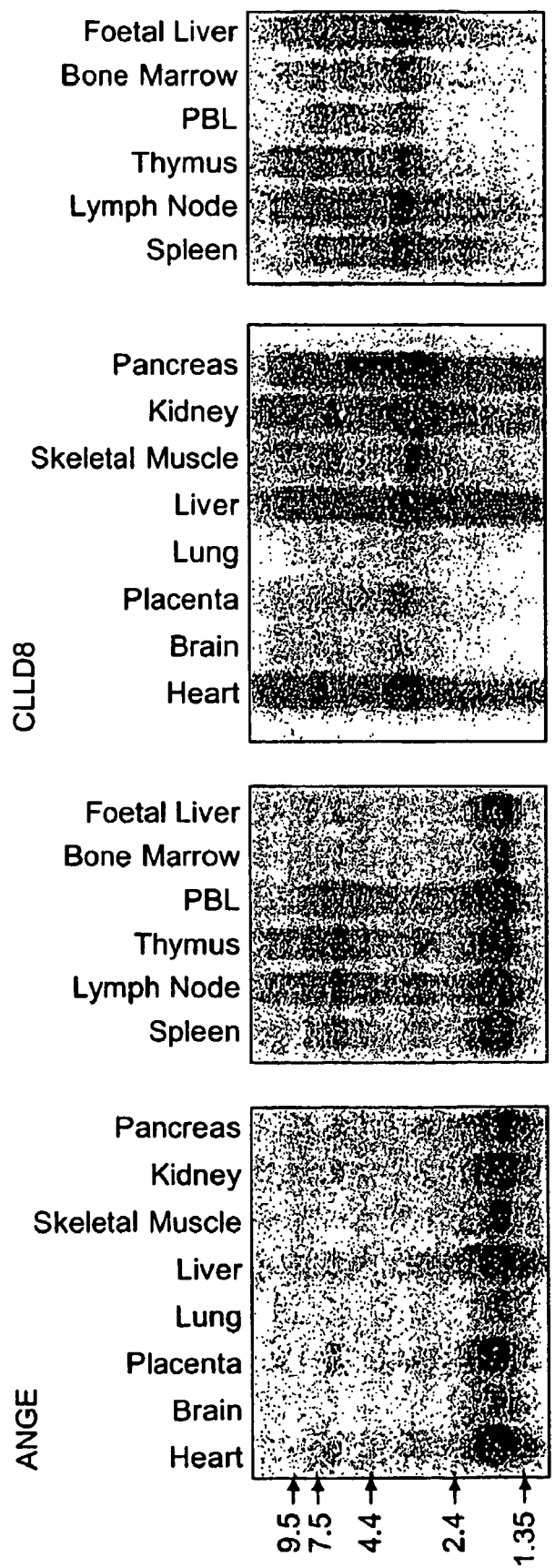

FIG. 10 shows Northern Blots of the gene for ANGE (NY-REN-34) and CLLD8. The presence of large bands and differential splicing in PBMC is apparent.

The images show alternative probings of the same Northern blot. The expected transcript size of approximately 1.6 Kb for ANGE is seen in all tissues. A 3.0 Kb band is prominent in lymph node and thymus, and polymorphic higher molecular weight bands between 6.0 and 8.0 Kb are visible in immune tissues. The expected 4.0 Kb band is seen for CLLD8 in all tissues. Additional higher molecular weight bands may also been seen, but their distribution does not coincide with that of ANGE.

Figure 11:
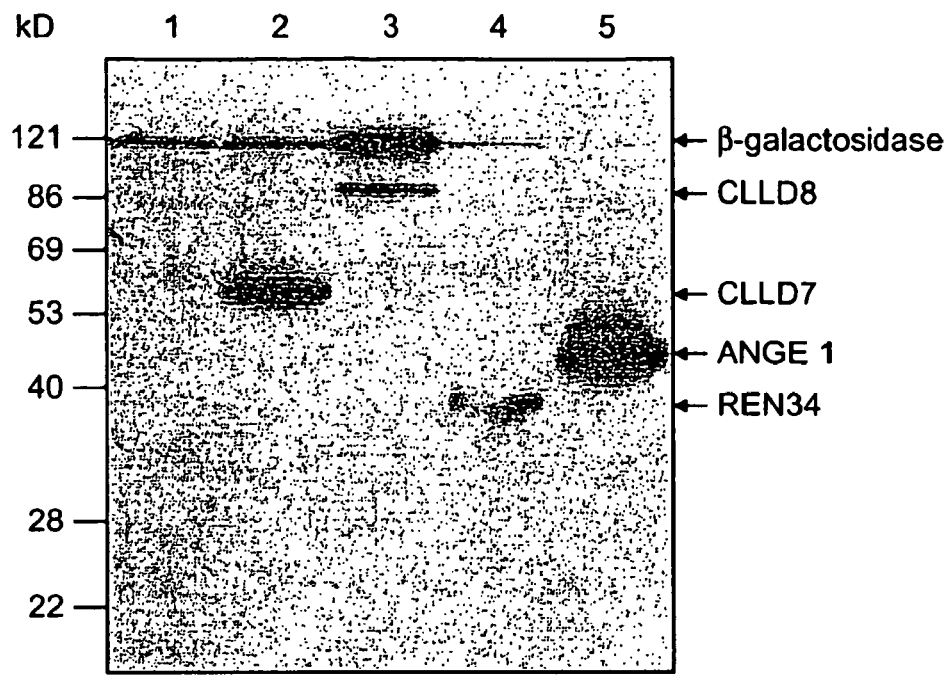

FIG. 11—Western blot of Cos-7 cells lysates after transient transfection with pcDNA4 expression vectors.

$3\times10^5$ cells were transfected with 1 μg pcDNA4His/MaxLacZ only (lane 1) or with 1 μg pcDNA4His/MaxLacZ plus 6 μg pcDNA4His/Max-CLLD7 (lane 2), 6 μg pcDNA4His/Max-CLLD8 (lane 3), 6 μg pcDNA4His/Max-REN34 (lane 4) and 6 μg pcDNA4His/Max-ANGE (lane 5). Cells were harvested 24 hours post-transfection and whole cell lysates run on a 10% polyacrylamide gel. Proteins were transferred to PVDF membrane, which was probed with an anti-polyhistidine antibody.

Figure 12:
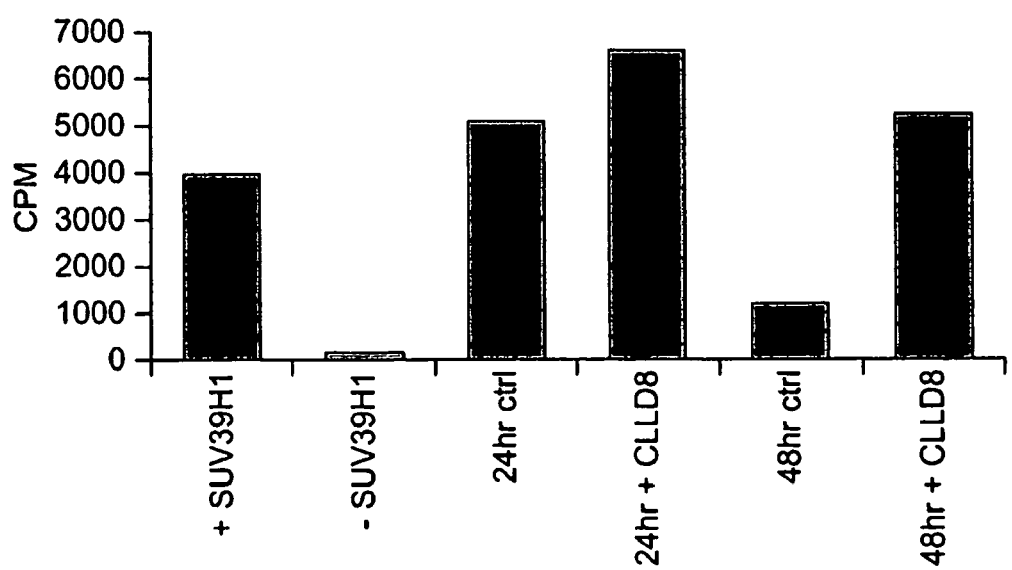

FIG. 12—HMT radioactive assay using nuclear extracts from Cos7 cells transfected with pcDNA CLLD8.

Cells were harvested either 24 or 48 hrs post-transfection with nuclear extracts being tested for HMT activity. The control extracts were treated with Fugene only. All Cos7 extracts equivalent to 11 ug total protein. Positive control=bacterial SUV39H1(82-412) 10 ug; negative control=no protein.

FIGS. 13a-d show examples of results obtained with each of the DNA probes containing a potentially functional SNP.

FIGS. 14a-c show the results of such immunolocalisation experiments. CLLD7 (a) and ANGE (b) have a punctate cytoplasmic localisation whereas CLLD8 (c) appears to be restricted to the nucleus of the COS-7 cells.

TABLE 1 shows associations between LnIgE and the identified SNPs in BAC bA103J18.03548, BAC bA101d11.0116 and BAC bA236 m15.00303.

The position is in base pairs from the beginning of the reference sequence from the BAC/PAC contig.

TABLE 2 shows association of common b4_2.b5_3.b43_1 haplotypes to total IgE in subject panels.
a) SNP/marker associations with total serum IgE.
b) Association of common b42.b5_3.b43_1 haplotypes to total IgE in subject panels.
c) Association with categorical traits (asthma and atopy).

TABLE 3 shows the full length cDNAs isolated from a 1 mb region of FIG. 5.

TABLE 4 shows the primer pairs used in the identification of the SNPs.
a) SNPS identified in region.
b) Shows the primer pairs used in RFLP assays.
c) SNP sequences PCR amplification between exon XII of CLLD8 and exon III of ANGE. Three bands are observed (A, B and C) and their splice structure is depicted in the insert. Band B, which lacks ANGE exon II, has an open reading frame that continues from CLLD8 through to ANGE. The highest molecular weight band arises from priming from a homologous sequence within the IgGFc locus.

TABLE 5 shows peptide sequences used to generate antibodies.

TABLE 6 shows putative functional promoter SNPs tested by EMSAs.

EXAMPLE 1

Subjects

The primary mapping was carried out on 364 subjects in 80 nuclear families sub-selected from a population sample of 230 families from the rural town of Busselton in Western Australia[3,51](The AUS1 panel). Families in the panel included both atopic and non-atopic members, and sibships of three or greater were not exclusively atopic or non-atopic. The AUS2 panel consisted of the remaining 150 nuclear families from the population sample. The UK2 panel consisted of 87 nuclear families recruited through a child attending an asthma clinic in the Oxford region. The families contained 216 offspring (148 sibling pairs). The ECZ panel consisted of 150 nuclear families recruited from the dermatology clinics at the Great Ormond Street Hospital for Children, through a child or children with active AD, as previously described[30].

Phenotypes

Skin tests to House Dust Mite (HDM) and mixed grass pollen (less the response of negative controls), specific IgE titres to HDM and Timothy Grass, and the total serum IgE were measured as previously described (Hill, M. R., James, A. L., Faux, J. A. & et al *British Medical Journal* 311, 776-9 (1995)). A "Skin Test Index (STI)" was calculated as the sum of the prick skin test results to HDM and grass mix (95% of individuals in this population who were atopic reacted either to HDM, or to grass pollen or both). Bronchial responsiveness to methacholine was measured as previously described: the maximum dose administered was 12 μmol. The slope of the dose-response curve was calculated as (pre-dose forced expiratory volume in one second (FEV1)-last FEV1), the cumulative dose of methacholine. A constant of 0.01 was added to each measurement, to allow $\log_e$ transformation when Slope was 0. Eosinophils in peripheral blood were Coulter-counted and the values loge transformed before analysis.

"Atopy" was defined as a STI>5 mm, or a RAST score to HDM and Timothy Grass>2, or a total serum 1gE>the $7^{th}$ decile of the age-corrected population. "Normal" was defined as a STI of 0 and a RAST Index of 0, and a total serum IgE<the $7^{th}$ decile of the age and sex-matched population. Intermediate phenotypes were classified as unknown.

The subjects were administered a modified British MRC questionnaire as previously described. "Asthma" was defined as a positive answer to the questions "Have you ever had an attack of asthma?" and "If yes, has this happened on more than one occasion?"

SNP Discovery and Typing

Discovery of SNPs was performed through direct sequencing of non-repetitive DNA fragments that were greater than 1000 Bp in length. For each sequence reaction, primers designed covering 500-600 bps genomic sequence. Five individual samples and one pooled DNA panel of 32 individuals were sequenced. Traces were assembled by the Polyphred/Phrap programmes. Following this random SNP discovery, sequencing of all exons with 250 bp leading and trailing DNA was carried out for all potential candidate genes from the region.

SNP typing was by PCR and restriction digestion. In the absence of a natural restriction site, one primer was modified to generate a restriction site. PCR was carried out in 10 μl reaction which contained 1) 5 μl 10 ng/μl individual DNA; 2) 5 pmol forward and reverse primers; 3) 0.08 u TaqGold; 4) 1.5-3 mM $Mg^{2+}$. PCR carried at 94° C. for 15 minutes then 35 cycles for 1) 94° C. 30 s; 2) 50-60° C. 30 s; 3) 72° C. 45 s. After finishing PCR, the jplates were tested for checking if the PCR worked, then 5 μl digestion solution which contained 1-2 u restriction enzyme added to each reaction. Samples were run in 2-4% agrose gels after 3-5 hours digestion. Total 40 SNPs were typed in the Busselton and UK1 family sets.

Statistical Analysis of Association

Errors in SNP typing were detected by testing for Mendelian errors and by the MERLIN computer program (internet site at bioinformatics.well.ox.ac.uk/Merlin), which identifies improbable recombination events from dense SNP maps. SNP haplotypes were generated by MERLIN and recoded as individual alleles.

Tests of association to quantitative traits were carried out by the QTDT program, which allowed use of markers and phenotypes as covariates in analyses[29]. Association to asthma and categorical traits was examined by the Monks test routine of QTDT[29,31]

Sequence Analyses

Genomic sequence was analysed using a modification of HPREP (G. Micklem, unpublished); screening for repeat elements in RepBase[52] using REPEATMASKER (Smit, A. F. and Green, P. internet site at repeatmasker.genome.washington.edu) for matches to human, rodent, EST, STS and other DNA databases, SWISSPROT, TREMBL and TREMBLNEW peptide databases, CpG islands using CPG[53], transcription factor elements and putative promoter regions using PROMOTERSCAN[54], and exon predictions using GRAIL[55], GENSCAN[56], GENEPARSER[57] and MZEF58. Annotations were collated using ACeDB (internet site at www.acedb.org/). Known genes were identified using BLASTN[59] the EMBL DNA database. The peptide databases SWISSPROT, TREMBL and TREMBLNEW were searched using BLASTX[59] for homologues to transcripts of unknown function. Putative roles for remaining transcripts were established using PSI-BLAST[59] and SMART[60].

IMAGE Clone Sequence and Extension

IMAGE clones mapping to the region were obtained from Research Genetics and sequenced on a 377 DNA sequencer using ABI Prism Big Dye Terminator (PE Applied Biosystems). Consensus sequences for each IMAGE clone was aligned by the GCG program. Marathon-Ready™ cDNA RACE libraries were obtained form CLONTECH to extend 5' and 3' cDNA ends of the IMAGE clones. Two gene-specific primers (GSP) were designed for each direction for each consensus. Distinct bands from RACE PCR were cut from gels and purified. The bands were cloned with ZERO Blunt™ PCR Cloning kit from Invitrogen. The inserts were sequenced using Big Dye Terminator, and integrated into consensus sequences with GCG.

Tissue Expression

Human Multiple Tissue Northern (MTN™) Blots and Human Immune System MTN blots were obtained from CLONTECH. Human Multiple Tissue, Human Immune System and Human Blood Fractions Multiple Tissues cDNA Panels from CLONTECH were used for expression analysis by PCR amplification of target sequences.

Systematic investigation of the exonic and intronic structure of the splice variants of ANGE was carried out by selective PCR, gel separation of products, cloning with ZERO Blunt™ PCR Cloning kit, and Big Dye Terminator sequencing.

EXAMPLE 2

A saturation genetic map of chromosome 13q14 identified a one lod support unit for the location of the atopy locus within a 7.5 cM region centred on D13S161[17]. A 1.5 Mb BAC and PAC contig was constructed, centring on D13S273. A positive association between the total serum IgE and alleles of the microsatellite USAT24GI in two panels of families[4] was found.

The limit of detection of linkage disequilibrium (LD) between a disease and a marker given our sample size is likely to be less than 100 Kb[18,19], suggesting that the atopy gene was within 100 Kb in either direction of USAT24GI. This region of chromosome 13q14 is commonly deleted in B-cell chronic lymphocytic leukaemia (BCLL)[20].

Scaffold sequence tag sites (STSs) from our BAC/PAC contig were then used to prioritise genomic sequencing of the central 1 Mb of the locus. These STSs were mapped on to BAC contigs built by a combination of Hind III digest fingerprinting and STS content[23,24]. An overlapping set of clones from the RPCI-11 BAC library[25] was sequenced using a hierarchical shotgun sequencing strategy[26]. The sequence of the region (in the form of 3 BACs) is shown in FIGS. 5, 6 and 7.

Linkage Disequilibrium Mapping

SNPs were detected by sequencing repeat-free contigs than 1.5 Kb in length in 5 unrelated atopic subjects and 5 unrelated controls, together with a pool of DNA from 32 unrelated individuals.

Association to Quantitative Traits

Forty-seven SNPs and a 15 bp deletion-insertion polymorphism were identified with minor allele frequencies $20%. These were genotyped in our primary panel of 364 individuals in 80 nuclear families[3,4]. Error checking and haplotype generation was carried out by the MERLIN computer program[27]. Linkage disequilibrium (LD) between markers was assessed by estimation of D' from the parental haplotypes[18] and portrayed by the GOLD program[28]. LD was roughly distributed into three major and one minor islands (A, Aii, B and C)(FIG. 1a), defining regions in which association to disease could be localised.

Association was sought between the $\log_e$(IgE concentration) (LnIgE) and the SNPs by variance components analyses[29] (Table 1).

Association to LnIgE clustered around the 185752b4_2 SNP and extended for approximately 100 Kb within the A and Aii islands of LD (Table 1). Association to the STI was less well defined, but seemed to be centred around 4321017b38_1 and extend for 150 kb. The distance between the two peaks was approximately 160 kb.

In order to test if these peaks corresponded to distinct QTLs, associations to the LnIgE were tested with the STI as a covariate and vice versa (Table 1). Associations were similarly tested with 185752b4_2 and as covariates. In each case the LnIgE/185752b4_2 complex appeared as distinct from the STI/4321017b38_1 complex.

The region of association to LnIgE extended across 3 genes (Table 1)(FIG. 1b). The identification of the genes is described below. Inclusion of markers in the first or third genes as covariates (b1_1 or 44593_15) did not abolish the association within the middle gene, whereas the use of a marker in this gene as a covariate (b4_2) removed the evidence for association in the outer regions. These results suggested that the QTL is contained within the centre of markers, which show association to the LnIgE.

In order to test for replication, six markers (b11_2, b4_2, b5_3, b43_1, b38_1 and b28_2) were typed in other panels of subjects. In order to minimise the numbers of comparisons, the markers were assembled into 3-marker haplotypes, and multi-allelic tests of association were performed before examining individual haplotypes. The b4_2, b5_3, b43_1 haplotype showed consistent association to the LnIgE in each of the panels tested (Table 2). Two haplotypes containing the b4_2*2 and the b5_3*1 alleles (A and D, Table 2) showed negative association with the LnIgE, although they differed at the b43_1 locus. Positive association was observed with the C haplotype (containing b4_2*1 and b5_3*2) in a panel of families with atopic dermatitis[30]. These results further suggest that the polymorphism influencing IgE levels is nearest to b4_2 and b5_3.

The combined panel of Busselton families (AUS1 and AUS2) may be taken to be representative of the general population. Association was seen to asthma in these subjects with the b4_2 and b5_3 markers (p=0.024 and p=0.017 respectively) using a transmission disequilibrium test[31].

Association to Categorical Traits

Gene Identification and Domain Homologies

Unfinished BAC sequence of the region was assembled and annotated. Systematic identification of expressed sequences was carried out by examination of EST databases and from a cDNA selection experiment[4]. Partial sequences from these sources were consolidated into cDNA contigs, and further extended these by 3' and 5' RACE and Northern blotting was carried out to determine transcript sizes, and to examine tissue expression of the genes.

Six full length cDNAs were identified from the 1 Mb region of genomic sequence (Table 3). Four other sequences were found in the EST databases, but did not have open reading frames (ORFs) or a splice structure and were likely to be genomic contaminants (UniGene clusters Hs.58452, Hs.268773, and Hs.212161).

Physical mapping of the chromosome 13q14 BCLL locus cell has recently identified 5 of these genes[22]. Three were considered novel candidate genes for leukemogenesis and were named as CLLD6, CLLD7, and CLLD8. The other genes are karyopherin-∀3 (KPNA3) and the gene corresponding to the NY-REN-34 antigen (ANGE). The sixth gene is Emopamil-binding related protein (EBRP).

Sequence homologies for the three distal genes do not suggest an obvious role in atopy or asthma: EBRP may act as a D8-D7 sterol isomerase in cholesterol biosynthesis, the sequence of KPNA3 suggests that it is involved in the nuclear transport system[32], and CLLD6 contains a SPRY domain, suggesting possible microtubule-binding. The three remaining genes form a tight cluster which contains the region of association to LnIgE levels (Table 1)(FIG. 1b).

CLLD8

Figure 8:
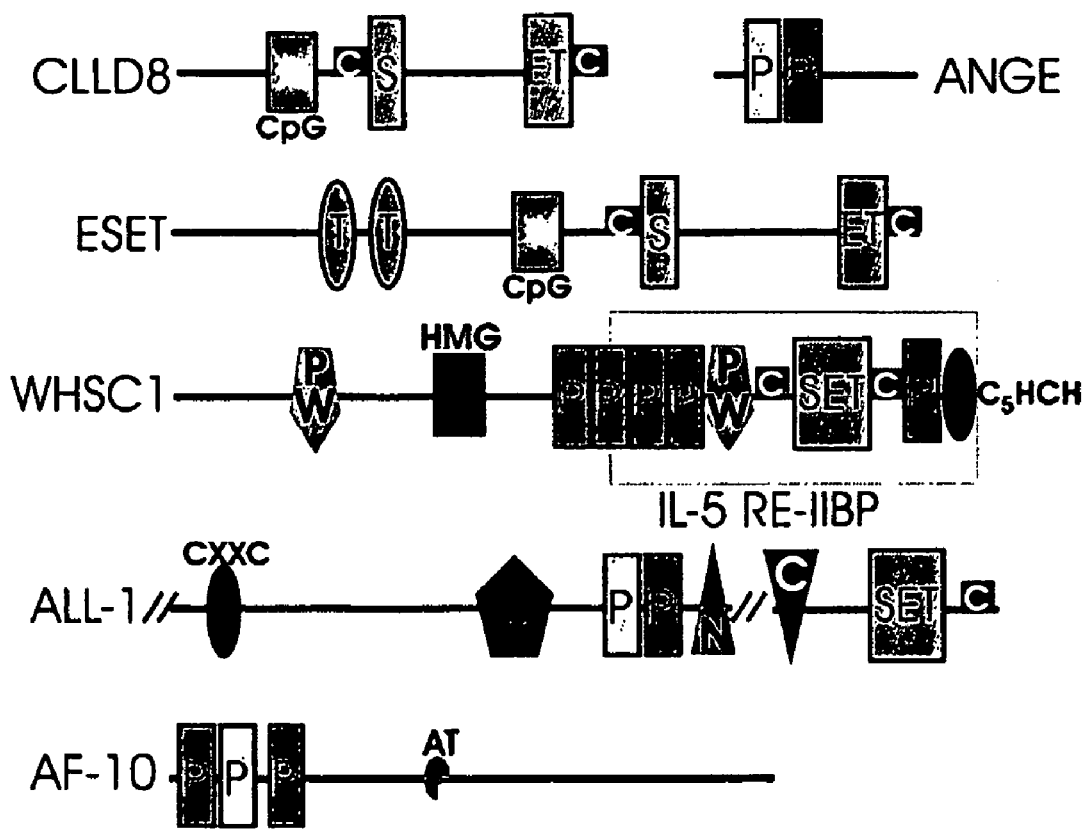
FIG. 8 shows domain architectures of CLLD8, ANGE and related proteins, drawn approximately to scale.

The most proximal gene, CLLD8, contains both a methyl-CpG-binding domain (MBD) and a SET domain[22](FIG. 8). The MBD appears to lack amino acids required to bind methylated CpG[33,34], but remains likely to bind DNA. SET domains modulate gene expression epigenetically through histone H3 methylation[35-37]. CLLD8 is likely to be a H3 methyltransferase since it contains both active site and flanking cysteine residues that are important for catalytic activity[37].

Histone Methyl Transferases

The expression of genes in eukaryotic organisms is dependent on DNA accessibility. In its natural state, DNA is packaged around a set of histones, H2A, H2B, H3 and H4. Further higher order compaction is facilitated by the interaction with H1 histone and other non-histone proteins. In this condensed state, chromatin is inaccessible to the transcription machinery and thus genes contained within it are silent. Histone methyl transferases play a critical role in the regulation of gene expression. In mammalian cells, these enzymes are known to methylate histones H3 and H4 at specific lysine residues. The most widely studied member of this protein family is SUV39H1, which selectively methylates histone H3 at lysine residue 9 (K9). The catalytic domain of this enzyme is contained within a highly conserved sequence known as the SET domain. This sequence is required in combination with two flanking cysteine-rich sequences (Pre-SET and Post-SET) to facilitate histone methylation. Thus the PreSET-SET-PostSET domain is regarded as a characteristic signature of histone methyltransferase proteins. CLLD8 contains an expanded SET domain and a methyl binding domain, a structure that is capable of recognising methylated DNA.

Reference: Kouzarides, T. "Histone Methylation in transcriptional control" (2002) Curr Opin Genet and Devel 12:198-209

ANGE (NY-REN-34)

The next gene is approximately 4 Kb distal to the 3' end of CLLD8 and is transcribed in the same direction. It encodes NY-REN-34 antigen which was identified by serological analyses of cDNA products from four patients with renal cell carcinoma[38]. Transcripts of the gene are also highly represented in stomach, tonsil and in B-cells (UniGene cluster 279799). The gene product contains two PHD (plant homeo domain) zinc fingers, which suggest its involvement in chromatin-mediated transcriptional regulation[39](FIG. 8). PHD fingers normally posses two $Zn^{2+}$ co-ordinating groups which contain cysteine and histidine residues. The N-terminal (5') of the NY-REN-34 finger pair however lacks one of the two coordinating groups.

The arrangement of PHD fingers in NY-REN-34 is characteristic of human proteins such as ALL-1 and AF10 whose genes are fused in some cases of acute lymphoblastic leukaemia[40](FIG. 8). Analogy to AF10[41] and ALL[42] PHD fingers suggests that the NY-REN-34 PHD finger pair is likely to possess a homodimerisation or a protein-binding role or both. NY-REN-34 has also been called BCAP (BRCA1-C terminus associated protein)(EMBL accession AB011031) and is likely to interact with the BRCT domains of BRCA1. These domains are capable of stimulating transcription, remodelling chromatin and interacting with histone-modifying enzymes such as the histone acetyltransferase p300 and the human histone deacetylase, HDAC[43].

CLLD7

CLLD7 follows only 3 Kb from the end of ANGE, but is transcribed in the opposite direction. It shows strong protein sequence similarity to RLG and RCC1 (regulator of chromatin condensation 1). RCC1 binds to DNA and to histones H2A and H2B44. CLLD7 contains a BTB/POZ domain, which classically form homophilic and heterophilic dimers.

Remodelling of chromatin structure is important in transcriptional regulation of genes influencing IgE production[45], so CLLD8, ANGE and CLLD7 may all be considered candidates for influencing atopic processes. However, CLLD8 and ANGE both contain domain homologies to the IL-5 promoter REII-region-binding protein (RE-IIBP)[46], as well as to genes found in leukaemia (ALL)[40] and multiple myeloma (MMSET)[46,47] (FIG. 8). This suggests a role in immune regulation and immunoglobulin production.

CLLD8 and ANGE (NY-REN-34) Co-Expression

The close genomic proximity of CLLD8 and ANGE raises the possibility of co-ordinate expression of both genes, or expression of a combined gene product that would be similar to RE-IIBP[46]. PCR between exon XII of CLLD8 and exon III of ANGE identified three bands (A, B and C) which were expressed in most tissues (FIG. 10). Each band contained a specific splice structure (FIG. 3), but our sequence did not identify an extended open reading frame in any of the bands. Despite the absence of an open reading frame, the non-random splice structure suggests a function, which may be regulatory.

Tissue Expression and Splice Variation

Figure 2:
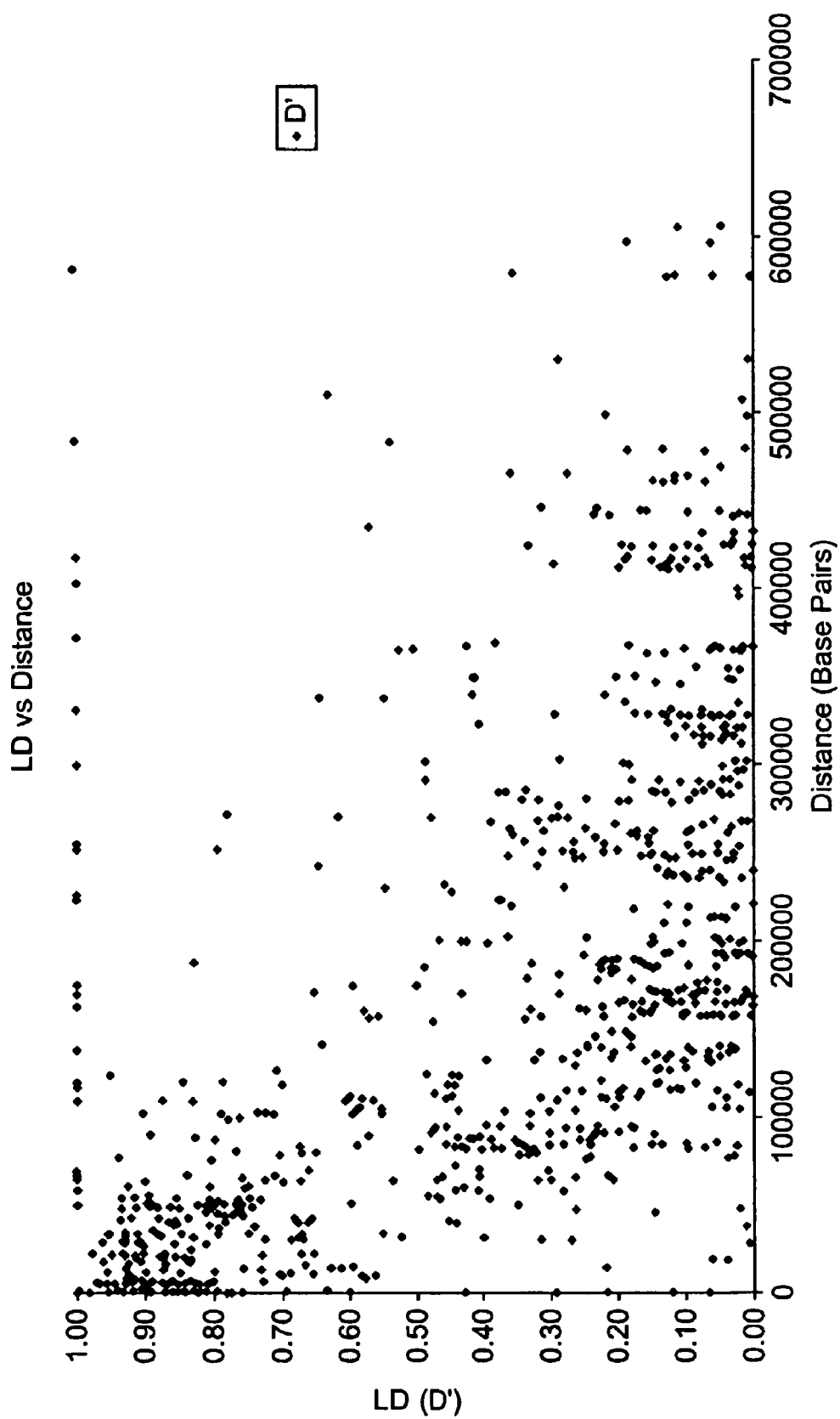

We examined northern blots of CLLD8, ANGE and CLLD7. The northern for ANGE showed polymorphic high molecular weight bands (FIG. 10). High molecular weight bands were also seen with CLLD8, but these did not match the tissues in which similar bands were seen with ANGE (FIG. 2). CLLD6 and the other genes from the contig showed the expected size bands with a uniform and ubiquitous tissue distribution.

The ANGE gene contains 10 exons. Examination of the public databases identified a number of alternative first exons with alternative start methionines for protein translation (EMBL:AF155105, AL552215, B1463029, BG759124). We have been able to identify all of these variants by sequencing of specific PCR products from cDNA panels (data not shown). In addition, versions of the cDNA show skipping of exon II were found (ESTHUM: BF662927 and BE787177, EMBL:AL552215). The AL552215 variant results in an incomplete first PHD domain, that would not be anticipated to be functional.

Exon-specific PCR of cDNA from multiple tissue panels identified exon II skipping variants to be present at approximately the same concentration in all tissues (FIG. 4a).

Highly tissue-specific splice variants were found which contained additional exons between exons V and VI (named exon Va and Vb). These variants differed by 54 bps, and were present in lung and peripheral blood leucocytes (PBL) (FIG. 4b). Examination of PBL fractions showed that the splice variants were present in unactivated CD4+, CD8+ and CD19+ cells, but absent in activated cells. Both exons result in a premature stop codon. Alternative splicing with a premature stop codon has previously been identified as mechanism for negative control of transcription[48], and a negative role for these variants is consistent with their expression in inactive T and B Cells.

A splice variant in which intron VII was retained between exons VII and VIII (ESTHUM: BE141730), which was most strongly expressed in active CD4+ and CD8+ leukocytes was observed (FIG. 4c). This variant also results in a premature stop codon.

ANGE

The identification of ANGE (NY-REN-34) by positional cloning rests on three lines of evidence: genetic localisation, tissue expression, and inferred or demonstrated gene function. In the present case, although the region of association to the total serum IgE concentration extends across three genes, our analysis suggests that this is attributable to polymorphism within the gene for ANGE (FIG. 1, Table 1, and Table 2). Domains from CLLD8 and ANGE have homologies with known B-Cell transcription factors. Only one gene, ANGE, has differential expression in immune cells and tissues, and is likely to be responsible for atopy at this locus.

We have carried out further sequencing of ANGE and CLLD8 for 5' regions, all exons, and non-repetitive areas of introns. One conservative coding (Glu-Gly) variant was found in CLLD8, and showed only weak association with the IgE($p<0.01$). One non conservative (Pro-Ser) variant was found in ANGE (ANGE1×3C148T). A non conservative coding (Val-Ala) variant was found in CLLD7 (CLD703).

The SNPs within the A island of ID were in strong disequilibrium. Control regions for genes may extend for 100 Kb[49], and we have observed at least two haplotypes with different effects on serum IgE levels. Our results indicate that loci underlying complex traits will contain several polymorphisms with different functional consequences[50].

EXAMPLE 3

Sequence Analyses

DNA sequence from overlapping, unfinished BACs was assembled to form larger contigs using contigwalk, a systematic comparison and extension tool using BLASTN (S. J. Broxholme, unpublished). A framework map of the region of interest was prepared using vector scores of STS markers from the critical region in the Genebridge4 Radiation Hybrid panel and the Radiation Hybrid mapping software RHMAP-PER (Stein, L., Kruglyak, L., Slonim, D., Lander, E. (1995) internet site at www.genome.wi.mit.edu/- ftp/pub/software/rhmapper.) RHMAPPER was then used to find markers in RHDB (Rodriguez-Tome, P. & Lijnzaad, P *Nucleic Acids Res* 29, 165-6. (2001)) that could be placed within this framework.

For each RHDB entry placed within the framework, the accession number was found from its annotation, and ESTs were selected for the next stage. TIGR Assembler (Sutton G. G., White O., Adams, M. D. and Kerlavage, A. R. (1995)

Genome Science & Technology, 1, 9-19) was used to make a non-redundant set of sequences.

Genomic sequence was analysed using a modification of hprep (G. Micklem, unpublished); screening for repeat elements in RepBase (Jurka, J. Trends Genet 16, 418-20. (2000)) using RepeatMasker (Smit, A. F. A. and Green, P. internet site at repeatmasker.genome.washington.edu); for matches to human, rodent, EST, STS and other DNA databases, SWISSPROT, TREMBL and TREMBLNEW peptide databases, CPG islands using cpg (Larsen, F., Gundersen, G., Lopez, R. & Prydz, H. Genomics 13, 1095-107. (1992)), transcription factor elements and putative promoter regions using promoterscan (Prestridge, D. S J Mol Biol 249, 923-32. (1995)), and exon predictions using GRAIL (Xu, Y., Mural, R. J. & Uberbacher, E. C. Comput Appi Biosci 10, 613-23. (1994)), GENSCAN (Burge, C. & Karlin, S. J Mol Biol 268, 78-94. (1997)), geneparser (Snyder, E. E. & Stormo, G. D. Nucleic Acids Res 21, 607-13. (1993)) and MZEF (Zhang, M. Q. Proc Natl Acad Sci USA 94, 565-8. (1997)). Annotations were collated using ACeDB (internet site at www.acedb.org/).

Known genes were identified using BLASTN (Altschul, S. F. et al. Nucleic Acids Res 25, 3389-402. (1997)) against the EMBL DNA database. The peptide databases SWISSPROT, TREMBL and TREMBLNEW were searched using BLASTX (Altschul et al., supra) for homologues to transcripts of unknown function. Putative roles for remaining transcripts were established using PSI-BLAST (Altschul et al., supra) and SMART (Schultz, J., Copley, R. R., Doerks, T., Ponting, C. P. & Bork, P Nucleic Acids Res 28, 231-4. (2000)).

IMAGE Clone Sequence and Extension

IMAGE clones mapping to the region were obtained from Research Genetics and sequenced on a 377 DNA sequencer using ABI Prism Big Dye Terminator (PE Applied Biosystems). The reaction contained 2 µl Bigdye, 2 µl Half Bigdye, 1 µl primer (5 µmol/µl), 1-4 µl plasmid DNA (400 ng) and 14-1 µl dsH20. The sequence reactions were performed in MJ thermal cycler. 1); 95° C.-1 min; 2) 95° C.-15 s; 3) 50° C.-10 s; 4) 60° C. -4mins; 5) repeated step 2 to 4 for 24 cycles [25 cycles total]; 6) 15° C.-hold. Consensus sequences for each IMAGE clone was aligned by the GCG program.

Marathon-Ready™ cDNA RACE libraries were obtained form CLONTECH to extend 5' and 3' cDNA ends of the IMAGE clone sequences. Two gene-specific primers (GSP) were designed for each direction for each consensus. There were about 150-200 bps overlapping sequence between the two GSP primers. GSP primers were designed to have 25-28 bps, 50-70% GC and Tm 65° C. Touchdown PCRs were used for the RACE the ends as: 1) 94° C. for 30 s, 2) 25-30 cycles at 94° C. for 5 s, 68-72° C. for 4 min.

Distinct bands from RACE PCR were cut from gels and purified. The bands were cloned with ZERO Blunt™ PCR Cloning kit from Invitrogen. The inserts were sequenced using Big Dye Terminator, and integrated into consensus sequences with GCG.

Northern Blot Analysis

Human Multiple Tissue Northern (MTN™) Blots and Human Immune System MTN blots were obtained from CLONTECH. The Human MTN Blot contained RNA from: heart, brain (Whole), placenta, lung, liver, skeletal muscle, kidney and pancreas. The Human Immune System MTN contained: spleen, lymph node, thymus, peripheral blood leukocyte, bone marrow and fetal liver. The Blots were hybridised with probes generated from cDNA colon or tissue cDNA solution. The average size of probes was 500-1000 bps. For gene i154016, the probe was 1180 bps from exon 1 to exon 10. The probes were radioactively labelled with [$^{32}$P]dATP using random primer method. All probes were hybridised at 42° C. overnight in Hybridisation solution (10% Dextran sulphate; 4×SSC; 50 mM sodium phosphate buffer pH7.2; 1 mM EDTA pH 8.0; 10× Denhardts; 50 mg/ml herring DNA sonicated; 1% SDS).

PCR Screening of MTC Panels

Human Multiple Tissue cDNA Panels and Human Immune System Multiple Tissues cDNA Panels from CLONTECH were used for expression analysis. The Human Multiple Tissues cDNA panel contained cDNA from: heart, brain, placenta, lung, liver, skeletal muscle, kidney and pancreas. The Human Immune System Multiple Tissues contained cDNA from: spleen, lymph node, thymus, tonsil, leukocyte, marrow and fetal liver. MTC panels were examined in all cDNA consensus sequence over the five BACs genomic sequence. PCRs were carried out in 50 µl which contained: 1)36 µl deionised H$_2$O; 2) 5 µl PCR buffer; 3) 1 µl advantaq Plus ; 4) 5 µl 8 mM dNTP and 5) 4 µl 5 pmol forward and reverse primers. PCR was performed as 1) 30 s at 94° C.; 2)22-38 cycles at 94° C. for 30 s, 68° C. for 2 min; 3) 68° C. for 5 min. In order to observe the abundance of the particular target, a total 5 µl sample each time was removed from the reactions at 22, 26, 30, 34 and 38 cycles.

For ANGE (NY-REN-34), the CLONETECH Human Blood Fractions MTC panel was also tested as above.

Systematic investigation of the exonic and intronic structure of the splice variants of ANGE was carried out by selective PCR, gel separation of products, cloning with ZERO Blunt™ PCR Cloning kit, and Big Dye Terminator sequencing.

Results

We then investigated the genes within the region of association. Unfinished BAC sequence of the region was assembled and annotated. Systematic identification of expressed sequences was carried out by examination of EST databases and from a cDNA selection experiment (G. Anderson. DPhil Thesis, Oxford University 2001). Partial sequences from these sources were consolidated into cDNA contigs and were further extended by 3' and 5' RACE. Northern blotting was carried out to determine transcript sizes, and to examine tissue expression of the genes.

Six full length cDNAs were eventually identified from the 1 Mb region of genomic sequence (Table 3). Five other sequences were found in the EST databases, but did not have open reading frames (ORFs) or a splice structure and were likely to be genomic contaminants (i274117, i46536, i513822, i143317 and i447262). Physical mapping of the chromosome 13q14 BCLL locus cell has recently identified three of the genes we found, which were named as CLLD6 (i2350400), CLLD7 (i44593), and CLLD8 (i626548) (Mabuchi, H. et al. Cancer Res 61, 2870-7. (2001)). These genes were considered novel candidate genes for leukemogenesis. Our analysis of the domain content of these genes agrees with the assessment of Mabuchi et al that CLLD7 might be involved in cell cycle regulation by chromatin remodelling and that CLLD8, which contains a SET domain, might be associated with methylation-mediated transcriptional repression. We have observed a SPRY domain in CLLD6, which might be involved in microtubule-binding. CLLD6 seems to be beyond the region of association to LnIgE or the STI.

The gene corresponding to image clone i154016 has been previously recognised to code for NY-REN-34 antigen, which was identified by serological analyses of cDNA from four patients with renal cell carcinoma (Scanlan, M. J. et al. *Int J Cancer* 83, 456-64. (1999)). Transcripts of the gene have also been consistently found in breast carcinoma and in tonsil. The gene contains two PHD domains, one of which is complete and the second of which is N-terminal (5') to the first and is missing one of its two zinc co-ordinating residue groups (mostly Cys). These two PHD domains are very similar to pairs of PHD domains in *Drosophila*/human trithorax and human ALL-1, suggesting that the gene for NY-REN-34 antigen is involved in chromatin-mediated transcriptional regulation (Aasland, R., Gibson, T. J. & Stewart, A. F. *Trends Biochem Sci* 20, 56-9. (1995)).

Image clone i1895799 is Emopamil-binding related protein, which acts as a D8-D7 sterol isomerase. Image clone i626789 is karyopherin alpha 3, with homologies that suggest that it may be involved in the nuclear transport system (Takeda, S. et al. *Cytogenet Cell Genet* 76, 87-93 (1997)).

Chromatin structure is important in transcriptional regulation of genes influencing IgE production (Lavender, P., Cousins, D., Smith, P. & Lee, T. Presentation at the National Asthma Campaign International Congress, June 1999. *Clin Exp Allergy* 30, 1697-708. (2000)) so that the SET domain and PHD domain-containing proteins (CLLD8 and NY-REN-34) are prime candidates for influencing atopic processes.

Mapping of the transcribed sequences back onto the SNP/LD map showed that three of the genes were contained under the peak of association to the LnIgE and STI (FIG. 1). These genes were NY-REN-34, CLLD7 and the D8-D7 sterol isomerase.

Further examination of the genes was based on their tissue expression. Northern blots of CLLD8 and CLLD7 and Karyopherin—showed ubiquitous expression of a single sized transcript, as previously described. However, NY-REN-34 showed differential splicing, with higher molecular weight bands present in immune tissues (FIG. 2).

Figure 3C:
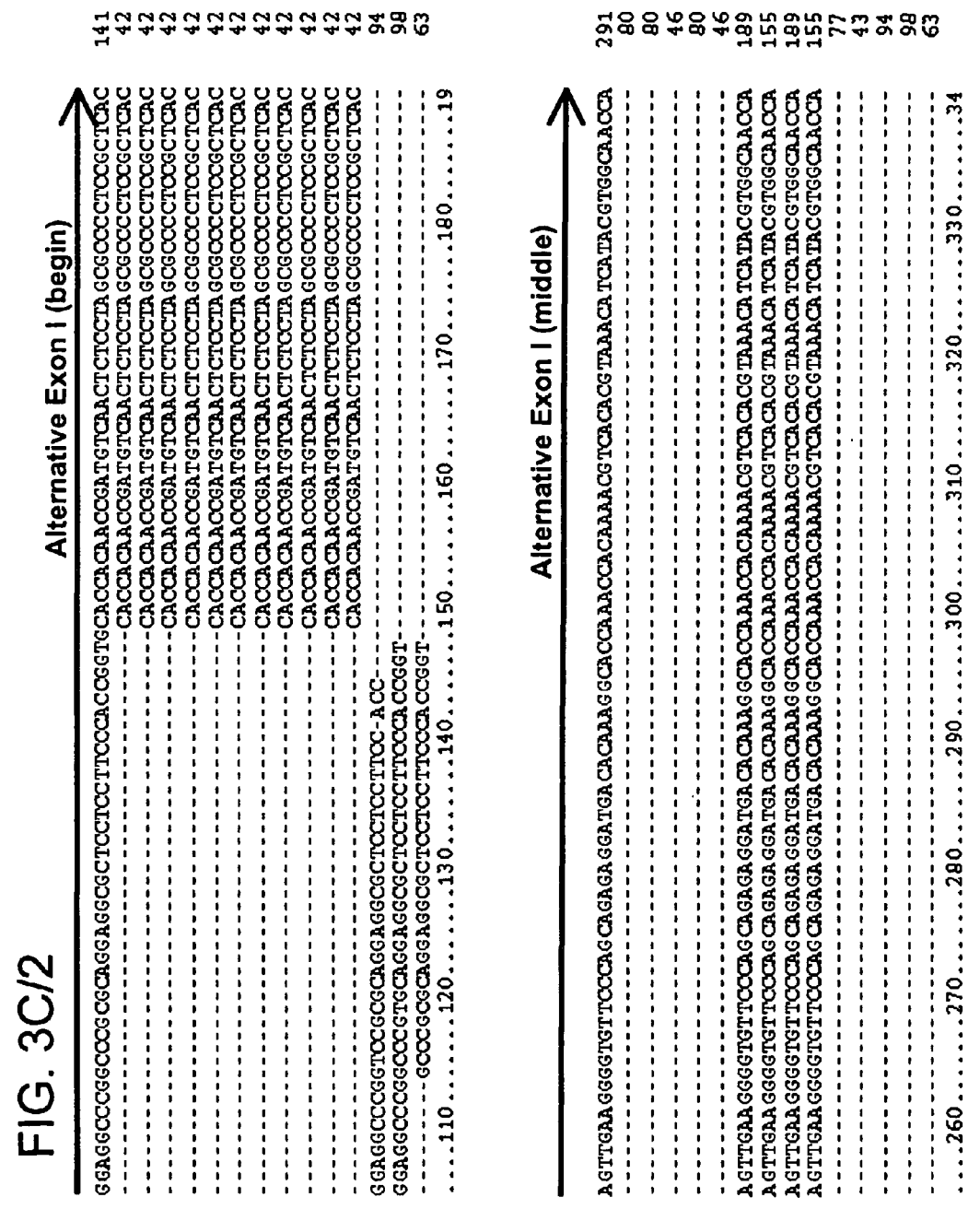

This gene was therefore examined in more detail. It consists of 10 exons, and an alternative exon 1 has been seen in W tissue (FIG. 3). Only one of these exons has a promoter (FIG. 3). We could only identify PCR products that contained the promoter-associated exon from multiple cDNA (MTC) panels. Further exon-specific PCR amplification of cDNA from the panels showed a number of unexpected bands (FIG. 4) in tissues. An alternative version within and without exon two was seen, and was present at approximately the same concentration in all tissues (FIG. 4a). We observed further additional bands when amplifying exons 4-6. These bands were highly tissue-specific, being present in lung and peripheral blood leucocytes (PBL) (FIG. 4b). Examination of PBL fractions showed that the splice variants were present in unactivated CD4+, CD8+ and CD19+ cells, but absent in activated cells. Sequencing of the splice variant band revealed the presence of an additional exon between exons 5 and 6. This resulted in an immature stop codon. Further splice variants were seen with amplification of exons 7-8 (FIG. 4c), which were specific to leukocytes.

The evidence therefore suggested that the gene for NY-REN-34 is responsible for atopy at this locus. It is situated at the peak of association to the LnIgE and the STI, its sequence homology suggests that it acts as a regulatory factor, and is differentially spliced in the specific tissues known to be involved in the regulation of IgE and the allergic response. We therefore have named the NY-REN-34 gene ANGE (atopy new gene).

There are many cell types and phenotypic readouts which can be measured to assess the contribution of these genes to the disease phenotype, including cell-cell interactions, inflammatory cell recruitment, inflammatory mediator release, and effector functions. We primarily used B cell lines as the model system for the cell based assays and IgE promoter activity as the main readout of B cell function.

EXAMPLE 4

It is of interest that CLLD8 is in close proximity (approximately 4 Kb) to ANGE, that ANGE has an alternate first exon without a promoter, and that high molecular weight bands were observed on Northern Blots of ANGE. In order to establish if CLLD8-ANGE may on occasion form a single gene product, PCR was performed between CLLD8 and ANGE exons in placental cDNA. A band was observed, indicating the presence with a gene with the domain structure CpGBD-PreSET-SET-PostSET-PHD-PHD. A similar domain structure has been observed in IL-5 promoter REII-region-binding protein (Garlisi, C. G. et al. *Am J Respir Cell Mol Biol* 24, 90-98. (2001)).

Mutations associated with 13q14 have not been identified in any of the genes mapped to this locus. However, the recognition that CLLD8/ANGE form a single transcript with differential splicing (FIG. 9) suggests that this gene may cause atopy.

EXAMPLE 5

Mammalian Cell Electroporation

Below is the protocol for the transfection of B cells by electroporation used in the IgE-luciferase reporter assay. These electroporation conditions have been optimised for B cells by measuring β-galactosidase activity after transfection with pcDNA4/HisMax-LacZ. The conditions used in the optimisation experiments are given in the Results section.

The human Burkitt lymphoma cell line DG-75 (DSMZ) was cultured in fresh RPMI plus 10% FCS 24 hours before transfection. The cells were harvested by centrifugation at 1000 rpm for 10 minutes and washed once in cold RPMI. $5 \times 10^6$ cells were resuspended in 400 μl cold RPMI and transferred to a 0.4 cm gap electroporation cuvette (BioRad) containing 10 μg pGL2 reporter vector, 10 μg pcDNA4/HisMax expression vector, and 1 μg pRL-TK (Promega) for normalisation of data to account for differences in transfection efficiency. A pulse was delivered at 1000 μF and 250V at room temperature using a Gene Pulser II Electroporator (Bio-Rad). Immediately after transfection 600 μl warm RPM plus 10% FCS was added to the cells which were transferred to 1 ml warm RPMI plus 10% FCS in a 6-well plate. The cells were cultured at 37° C. for up to 24 hours in the presence or absence of human recombinant IL-4 (Sigma).

Measurement of β-Galactosidase Activity in pcDNA4His/MaxLacZ-Transfected Cells 24 hours post-electroporation the transfection of B-cells was monitored by measuring β-galactosidase activity in cell lysates. Cells were harvested by centrifugation, washed twice in PBS and resuspended in Reporter Lysis Buffer (Promega). After incubating at room temperature for 15 minutes the lysates were centrifuged at 14,000 rpm for 10 minutes and the supernatants added to an equal volume of 2×β-galactosidase assay buffer (200 mM sodium phosphate pH7.3, 2 mM $MgCl_2$, 100 mM β-mercaptoethanol, 1.33 mg/ml ONPG). The reactions were incubated at room temperature or 37° C. until a yellow coloration had developed. 1 ml of 1M $NaCO_3$ was added and the absorbance read immediately at 420 nm.

X-gal Staining of pcDNA4His/MaxLacZ-Transfected Cells

Transfected cells were harvested by centrifugation, washed twice in PBS and fixed in 3.7% formaldehyde in PBS for 15 minutes at room temperature. After washing three times with PBS the cells were incubated in X-gal solution (0.2% X-gal, 2 mM $MgCl_2$, 5 mM $K_4Fe(CN)_6 \cdot 3H_2O$, 5 mM $K_3Fe(CN)_6$) for 2-16 hours at 37° C.

Dual Luciferase Assay

800 µl of transfected-cell suspension was centrifuged at 3000 rpm for 10 minutes and washed with 1 ml PBS. The cell pellet was resuspended in 50 µl passive lysis buffer and incubated for 20 minutes at room temperature on a rotating wheel. The lysates were briefly centrifuged at 14,000 rpm and dual luciferase activity was measured in 20 µl of the supernatant using the Dual-Luciferase Reporter System (Promega) according to the manufacturer's instructions.

WST-1 Proliferation Assay

U2OS cells were seeded in a 96-well plate at $3 \times 10^3$ cells per well and cultured at 37° C. for 24 hours in DMEM plus 10% FCS. Transfections were performed in triplicate using 300 ng pcDNA4/HisMax expressing CLLD7, CLLD8, REN34 or ANGE and 0.2 µl FuGENE 6 transfection reagent mixed in 20 µl Optimem, as described in section a. The cells were cultured for 24, 48, or 72 hours before adding 10 µl per well of WST-1 cell proliferation reagent. Absorbance was measured at 450/690 nm after a one-hour incubation at 37° C.

Histone Methyltransferase Assay

10 µg of SUV39H1(82-412)-GST protein (1 mg/ml) was added to 5 µg biotinylated H3 peptide (first 21 amino acids of Histone H3 with a Biotin label on the $CO_2H$ terminus from Upstate Biotechnology) in MAB (methylation activity buffer as described in Regulation of chromatin structure by site specific Histone H3 methyltransferases, Rea et al. Nature 406, 593-599, 2000. but using Tris-Cl pH 8.0) and water to a final volume of 100 µl, allowing for the addition of 600 nCi of $^{14}C$ s-adenosyl methionine as the radioactive substrate to initiate the reaction. This was incubated at 30° C. for 90 minutes. 30-50 µl of PBS washed Streptavidin Agarose beads (Sigma) were added at room temperature for 30 minutes with gentle agitation, to bind all biotinylated H3 peptide. Unbound reaction components were removed by washing beads in at least 10 volumes of PBS, spinning at low speed (~5000 rpm) and removing supernatant to aqueous waste, taking care not to remove any Agarose beads. The beads were then resuspended in 100 µl of PBS and added to 3 ml of scintillant fluid for counting of $^{14}C$ labelled methylated H3 peptide.

Screening Methods for Modulators of Methyltransferase Activity are disclosed in Patent WO 01/94621. The screening methods in this patent relate to modulators of murine SUV39H2-methyltransferase Screening for modulators of Suv39h2 Mtase activity (from WO 01/94621).

All steps are automated and the position of the different compounds being tested are registered on computer for later reference. Compounds being tested for modulating activity are aliquoted into 384 well plates in duplicate. 20-200 nmol of recombinant GST tagged human SUV39H2 in MAB buffer, is then added to the reaction. 20 nmol of branched peptide ([TARKST]$_4$-K$_2$-cys) which has been labelled with europium is then added, followed by 100 nmol of S-adenosyl methionine. This reaction is left at room temperature for 40 mins, then transferred onto a second plate to which the α-methH3-K9 antibody has been coated. This reaction is then left at room temperature for 40 mins to allow the antibody to bind methylated substrate. Following capture of methylated substrate, unbound non-methylated substrate is washed off in 50 mM tris pH 8.5. The europium label is then cleaved from the peptide in 50 µl pH 4.5 enhancement solution for 25 mins. The chelated europium molecules are then excited at 360 nm and the level of emitted fluorescence at 620 nm is then calculated using time-resolved fluorescence in a PolarStar plate reader. The results are then automatically graphed.

The level of fluorescence is directly related to the level of MTase activity. The effect of the different compounds on the MTase activity can be clearly seen on the graph when compared to control reactions with no compounds added or with no enzyme added. The principle of the screening method is as follows:

a) Suv39h2 is incubated with S-Adenosyl Methionine (SAM) and a chromogenically labelled unmodified peptide substrate (e.g. branched peptide [TARKST]$_4$-K$_2$-K-cys). Following methylation of this substrate the substrate becomes an epitope for a Lys9-methyl specific antibody which has been inmobilised on a microtiter plate. The level of bound peptide can then be quantified by the level of fluorescence of from the chromogenic label.

b) In the presence of a modulator (e.g. an inhibitor, I) the transfer of methyl groups by the MTase will be affected (decreased), this in turn will affect the amount of substrate captured by the immobilised antibody, which is quantified by the level of fluorescence. A compound with inhibitory effects will result in a decrease in fluorescence signal, whereas a compound with inhibitory effects will result in a decrease in fluorescent signal, whereas a compound with enhancing effects will result in an increase in fluorescent signal.

A truncated SUV39H1 (82-412), without the Chromo domain, was amplified by PCR from a Jurkat cDNA library and cloned into pGEX-2T. Histone methyl transferase activity of truncated protein was confirmed by radioactive assay.

Cloning of cDNAs into bacterial expression plasmids

All genes, CLLD7, CLLD8 and ANGE, were successfully amplified from I.M.A.G.E. consortium clones and cloned into the appropriate vectors: pET28a, pGEx4T and pGEx6P.

Expression of Proteins in Mammalian Cells

Full-length cDNAs for CLLD7, CLLD8, and ANGE 1 were cloned into pcDNA4His/Max plasmid (Invitrogen) for use in over-expression studies in B cells. Whole cell lysates were prepared 24 hours post-transfection and protein expression was detected by western blotting using an anti-polyhistidine monoclonal antibody. The bands that were detected in the western blot migrated at approximately the expected sizes for the recombinant proteins; CLLD7, 58 kDa; CLLD8, 82 kDa; REN34, 22 kDa; ANGE, 37 kDa (FIG. 11). This indicates that pcDNA4His/Max constructs are functional and express the genes of interest. Confirmation of these results was obtained by probing transfected Cos-7 cell lysates with an antibody to the Express Epitope (Invitrogen) for detection of ANGE and with specific antibodies to CLLD8 and ANGE.

IgE Reporter Assays

The human germline IgE promoter was cloned into the luciferase reporter vector pGL-2 Basic (Promega) in both forward and reverse orientations. pGL2 Control, in which the luciferase gene is under the control of the SV40 promoter (Promega), was used as a positive control for luciferase activity. For normalisation of data due to differences in transfection efficiency, cells were co-transfected with pRL-TK (Promega).

The effect of over-expression of CLLD7 on IgE promoter activity was measured. Cells were co-transfected with the IgE reporter construct +/−pcDNA4-CLLD7. Luciferase activity was measured 24-hours post-transfection and IgE promoter activity expressed as a ratio of firefly luciferase to renilla luciferase activity.

Histone Methyltransferase Assays

Histone methyltransferases (HMT) are chromatin-modifying enzymes functioning mainly in the nucleus but could have a role in the cytoplasmic compartment. Therefore, both nuclear and cytoplasmic extracts were purified from transfected Cos7 cells, for use in the HMT assay. Human SUV39H1 (used as a positive control in the assay) is a Lysine specific Histone methyltransferase that specifically methylates lysine 9 of Histone H3. Methylation of H3 has been shown to recruit HP1 protein resulting in formation of heterochromatin and may thus be involved in gene regulation/gene silencing (Rea et al.).

Nuclear extracts from Cos7 cells transfected with pcDNA CLLD8 were tested for HMT activity. In experiments transfected Cos cells showed increased HMT activity relative to the untransfected control (see FIG. 12).

EXAMPLE 6

Identification of SNPs that alter the function of a gene is of importance when the SNP is in a genomic region, which is known to be associated with the disease. This example describes one approach to functionally validate a SNP in a putative gene regulatory region such as a promoter or enhancer. Alterations in the normal function of these genomic regions influences the levels of transcription of the gene potentially affecting the levels of protein, the consequence of which leads to a disease state. The ability of proteins to bind to DNA with or without the SNP was demonstrated by electromobility shift assays (EMSAs). An alteration in the shifting pattern or intensity when comparing the wildtype and mutant DNA is indicative of differential binding of transcription factors. This differential effect potentially will result in differing expression patterns of the gene.

SNPs Tested

Four SNPs were identified by in-silico analysis using DB and Celera SNP databases which lay within predicted regions of the CLLD7, CLLD8 and ANGE gene promoters. The description of the SNP, oligonucleotide probes and potential transcription factor binding sites are shown in Table 7

Labelling of Oligos

The DNA target was produced by 3' biotin end labelling of complementary oligos with or without the SNP then incubated together to allow annealing to form a double stranded target DNA.

EMSA

Optimisation of double stranded oligo probe and nuclear extract was performed as demonstrated in the table. After incubation at room temperature, the samples were run on 5% polyacrylamide gels, electroblotted onto Biodyne charged membrane and the position of the biotin labelled oligos identified using the LightShift chemiluminescent EMSA kit (Pierce) as described by the manufacturers instructions and visualised by exposure to film or CCD camera.

Results

NR1 Oligos, hcv9873896, FIG. 13a

The results showed a difference in protein binding to the wild-type and the mutant oligos for NR1. There was an increase in the migration distance for the DNA-protein complex with the mutant oligo. This is possibly due to a decrease in affinity for the mutant oligo, the protein could be dissociating ot it is possible that a different protein from the nuclear extract could be binding to the DNA.

NR2 Oligos, clld7x1a295t, FIG. 13b

There was protein-DNA complex formation for both the wild-type and the mutant oligos but there did not appear to be any difference between the two.

NR3 Oligos, clld7prom1a351g, FIG. 13c

There was evidence of protein binding with the NR3 wild-type oligo but there was no binding detected with the mutant oligo.

NR4 Oligos, clld8x1a384 g, FIG. 13d

There was a very strong affinity for the protein by both the wild-type and the mutant oligos. There did not appear to be any difference in the affinity between the wild-type and the mutant oligo.

EXAMPLE 6a

In order to identify the cellular localisation of the CLLD7, CLLD8 and ANGE proteins we generated mammalian expression constructs which when transfected into cells have the ability to express the recombinant protein. Using antibodies specific to an epitope tag fused in frame with the protein of interest allows for visualisation of the protein within the cell.

Expression Cloning

The open reading frames of CLLD7 (1590 bp), CLLD8 (2157 bp) and ANGE (993 bp) were generated by PCR using full-length EST clones and the PCR product cloned into pcDNA-His.Max-TOPO (Invitrogen).

The frame and integrity of the orf was verified by double stranded sequencing of the insert. The plasmid expression construct was grown in bulk and purified ready for transfection of COS-7 cells.

Transfection and Analysis

Each purified plasmid clone was then transfected into the COS-7 cells using Fugene transfection reagent (Roche). Prior to transfection the COS-7 cells were cultured on cover slips overnight at $0.5 \times 10^5$ per well in a 24 well plate. Cover slips were then fixed and labelled with Xpress antibody (Invitrogen) and detected using the anti-mouse Cy3 antibody. Images were obtained by immunofluorescence microscopy (FIG. 14a, b, c).

REFERENCES

1. Jarvis, D. & Burney, P. ABC of allergies. The epidemiology of allergic disease [published erratum appears in BMJ 1998 Apr. 4; 316(7137):1078]. *British Medical Journal* 316, 607-10 (1998).
2. Eiberg, H., Lind, P., Mohr, J. & Nielsen, L. S. Linkage relationship between the human immunoglobulin E polymorphism and marker systems. *Cytogenetics, And Cell Genetics* 40, 622 (1985).
3. Daniels, S. E. et al. A genome-wide search for quantitative trait loci underlying asthma. *Nature* 383, 247-50 (1996).

4. Anderson, G. G., Leaves N. I, Bhattacharyya S., Zhang Y., Walshe V., Broxholme J., Abecasis G., Levy E., Zimmer M., Cox R., Cookson W.O.C.M. Positive association to IgE levels and a physical map of the 13q14 atopy locus. *Eur J Hum Genet* (in press) (2002).

5. Cookson, W. The alliance of genes and environment in asthma and allergy. *Nature* 402, B5-11 (1999).

6. O'Connor, G. T. & Weiss, S. T. Clinical and symptom measures. *Am J Respir Crit Care Med* 149, S21-8 (1994).

7. Duffy, D. L., Martin, N. G., Battistutta, D., Hopper, J. L. & Mathews, J. D. Genetics of asthma and hay fever in Australian twins. *Am Rev Respir Dis* 142, 1351-8 (1990).

8. Gerrard, J., Rao, D. & Morton, N. A genetic study of immunoglobulin E. *Am J Hum Genet* 30, 46-58 (1978).

9. Palmer, L. J. et al. Independent inheritance of serum immunoglobulin E concentrations and airway responsiveness. *Am J Respir Crit Care Med* 161, 1836-43 (2000).

10. Risch, N. J. & Zhang, H. Mapping quantitative trait loci with extreme discordant sib pairs: sampling considerations. *Am J Hum Genet* 58, 836-43 (1996).

11. Cookson, W. & Palmer, L. Investigating the asthma phenotype. *Clin Exp Allergy* 28 Suppl 1, 88-9; discussion 108-10 (1998).

12. Dizier, M. H. et al. Detection of a recessive major gene for high IgE levels acting independently of specific response to allergens. *Genet Epidemiol* 12, 93-105 (1995).

13. Kimura, K. et al. Linkage and association of atopic asthma to markers on chromosome 13 in the Japanese population. *Hum Mol Genet* 8, 1487-90 (1999).

14. Ober, C. et al. Genome-wide search for asthma susceptibility loci in a founder population. The Collaborative Study on the Genetics of Asthma. *Hum Mol Genet* 7, 1393-8 (1998).

15. Hizawa, N. et al. Genetic regulation of *Dermatophagoides pteronyssinus*-specific IgE responsiveness: a genome-wide multipoint linkage analysis in families recruited through 2 asthmatic sibs. Collaborative Study on the Genetics of Asthma (CSGA). *J Allergy Clin Immunol* 102, 436-42 (1998).

16. Beyer K, W. U., Freidhoff L, Nickel R, Björksten B, Huang S, Barnes K C, Beaty T, Marsh D G. Evidence for linkage of chromosome 5q31-q33 and 13q12-q14 markers to atopic dermatitis. *J Allergy Clin Immunol* 101, 152 (1998).

17. Bhattacharyya, S., Leaves, N. I., Wiltshire, S., Cox, R. & Cookson, W. O. A high-density genetic map of the chromosome 13q14' atopy locus. *Genomics* 70, 286-91 (2000).

18. Abecasis, G. R. et al. Extent and Distribution of Linkage Disequilibrium in Three Genomic Regions. *Am J Hum Genet* 68, 191-7 (2001).

19. Abecasis, G. R., Cookson, W. O. & Cardon, L. R. The power to detect linkage disequilibrium with quantitative traits in selected samples. *Am J Hum Genet* 68, 1463-74 (2001).

20. Oscier, D. G. Cytogenetic and molecular abnormalities in chronic lymphocytic leukaemia. *Blood Rev* 8, 88-97. (1994).

21. Kalachikov, S. et al. Cloning and gene mapping of the chromosome 13q14 region deleted in chronic lymphocytic leukaemia. *Genomics* 42, 369-77 (1997).

22. Mabuchi, H. et al. Cloning and characterisation of CLLD6, CLLD7, and CLLD8, novel candidate genes for leukemogenesis at chromosome 13q14, a region commonly deleted in B-cell chronic lymphocytic leukaemia. *Cancer Res* 61, 2870-7. (2001).

23. Bentley, D. R. et al. The physical maps for sequencing human chromosomes 1, 6, 9, 10, 13, 20 and X. *Nature* 409, 942-3. (2001).

24. McPherson, J. D. et al. A physical map of the human genome. *Nature* 409, 934-41. (2001).

25. Osoegawa, K. et al. A bacterial artificial chromosome library for sequencing the complete human genome. *Genome Res* 11, 483-96 (2001).

26. Lander, E. S. et al. Initial sequencing and analysis of the human genome. *Nature* 409, 860-921 (2001).

27. Abecasis, G. R., Cherny, S. S., Cookson, W. O. & Cardon, L. R. Merlin—rapid analysis of dense genetic maps using sparse gene flow trees. *Nat Genet* 30, 97-101 (2002).

28. Abecasis, G. R. & Cookson, W. O. GOLD—graphical overview of linkage disequilibrium. *Bioinformatics* 16, 182-3 (2000).

29. Abecasis, G. R., Cardon, L. R. & Cookson, W. O. A general test of association for quantitative traits in nuclear families. *Am J Hum Genet* 66, 279-92 (2000).

30. Cox, H. E. et al. Association of atopic dermatitis to the beta subunit of the high affinity immunoglobulin E receptor [see comments]. *Br J Dermatol* 138, 182-7 (1998).

31. Monks, S. A., Kaplan, N. L. & Weir, B. S. A comparative study of sibship tests of linkage and/or association. *Am J Hum Genet* 63, 1507-16. (1998).

32. Takeda, S. et al. Isolation and mapping of karyopherin alpha 3 (KPNA3), a human gene that is highly homologous to genes encoding *Xenopus* importin, yeast SRP1 and human RCH1. *Cytogenet Cell Genet* 76, 87-93 (1997).

33. Ohki, I., Shimotake, N., Fujita, N., Nakao, M. & Shirakawa, M. Solution structure of the methyl-CpG-binding domain of the methylation-dependent transcriptional repressor MBD1. *Embo J* 18, 6653-61 (1999).

34. Wakefield, R. I. et al. The solution structure of the domain from MeCP2 that binds to methylated DNA. *J Mol Biol* 291, 1055-65 (1999).

35. Rea, S. et al. Regulation of chromatin structure by site-specific histone H3 methyltransferases. *Nature* 406, 593-9 (2000).

36. Jenuwein, T. Re-SET-ting heterochromatin by histone methyltransferases. *Trends Cell Biol* 11, 266-73 (2001).

37. Nakayama, J., Rice, J. C., Strahl, B. D., Allis, C. D. & Grewal, S. I. Role of histone H3 lysine 9 methylation in epigenetic control of heterochromatin assembly. *Science* 292, 110-3 (2001).

38. Scanlan, M. J. et al. Antigens recognised by autologous antibody in patients with renal-cell carcinoma. *Int J Cancer* 83, 456-64 (1999).

39. Aasland, R., Gibson, T. J. & Stewart, A. F. The PHD finger: implications for chromatin-mediated transcriptional regulation. *Trends Biochem Sci* 20, 56-9 (1995).

40. Angioni, A. et al. Interstitial insertion of AF10 into the ALL1 gene in a case of infant acute lymphoblastic leukaemia. *Cancer Genet Cytogenet* 107, 107-10 (1998).

41. Linder, B. et al. Biochemical analyses of the AF10 protein: the extended LAP/PHD-finger mediates oligomerisation. *J Mol Biol* 299, 369-78 (2000).

42. Fair, K. et al. Protein interactions of the MLL PHD fingers modulate MLL target gene regulation in human cells. *Mol Cell Biol* 21, 3589-97 (2001).

43. Miyake, T., Hu, Y. F., Yu, D. S. & Lit R. A functional comparison of BRCA1 C-terminal domains in transcription activation and chromatin remodelling. *J Biol Chem* 275, 40169-73 (2000).

44. Nemergut, M. E., Mizzen, C. A., Stukenberg, T., Allis, C. D. & Macara, I. G. Chromatin docking and exchange activity enhancement of RCC1 by histones H2A and H2B. *Science* 292, 1540-3 (2001).
45. Lavender, P., Cousins, D., Smith, P. & Lee, T. Presentation at the National Asthma Campaign International Congress, June 1999. Controlling the inflammatory response through transcriptional mechanisms. *Clin Exp Allergy* 30, 1697-708 (2000).
46. Garlisi, C. G. et al. A unique mRNA initiated within a middle intron of WHSC1/MMSET encodes a DNA binding protein that suppresses human IL-5 transcription. *Am J Respir Cell Mol Biol* 24, 90-8 (2001).
47. Chesi, M. et al. The t(4; 14) translocation in myeloma dysregulates both FGFR3 and a novel gene, MMSET, resulting in IgH/MMSET hybrid transcripts. *Blood* 92, 3025-34 (1998).
48. Walker, W., Girardet, C. & Habener, J. Alternative exon splicing controls a translational switch from activator to repressor isoforms of transcription factor CREB during spermatogenesis. *J Biol Chem* 271, 20145-50 (1996).
49. Flint, J. et al. Comparative genome analysis delimits a chromosomal domain and identifies key regulatory elements in the alpha globin cluster. *Hum Mol Genet* 10, 371-82. (2001).
50. Terwilliger, J. D. & Weiss, K. M. Linkage disequilibrium mapping of complex disease: fantasy or reality? *Curr Opin Biotechnol* 9, 578-94. (1998).
51. Hill, M. R. et al. Fc epsilon RI-beta polymorphism and risk of atopy in a general population sample. *BMJ* 311, 776-9 (1995).
52. Jurka, J. Repbase update: a database and an electronic journal of repetitive elements. *Trends Genet* 16, 418-20 (2000).
53. Larsen, F., Gundersen, G., Lopez, R. & Prydz, H. CpG islands as gene markers in the human genome. *Genomics* 13, 1095-107 (1992).
54. Prestridge, D. S. Predicting Pol II promoter sequences using transcription factor binding sites. *J Mol Biol* 249, 923-32 (1995).
55. Xu, Y., Mural, R. J. & Uberbacher, E. C. Constructing gene models from accurately predicted exons: an application of dynamic programming. *Comput Appl Biosci* 10, 613-23 (1994).
56. Burge, C. & Karlin, S. Prediction of complete gene structures in human genomic DNA. *J Mol Biol* 268, 78-94 (1997).
57. Snyder, E. E. & Stormo, G. D. Identification of coding regions in genomic DNA sequences: an application of dynamic programming and neural networks. *Nucleic Acids Res* 21, 607-13 (1993).
58. Zhang, M. Q. Identification of protein coding regions in the human genome by quadratic discriminant analysis. *Proc Natl Acad Sci USA* 94, 565-8. (1997).
59. Altschul, S. F. et al. Gapped BLAST and PSI-BLAST: a new generation of protein database search programs. *Nucleic Acids Res* 25, 3389-402 (1997).
60. Schultz, J., Copley, R. R., Doerks, T., Ponting, C. P. & Bork, P. SMART: a web-based tool for the study of genetically mobile domains. *Nucleic Acids Res* 28, 2314 (2000).

SEQUENCE LISTING (326 sequences)

SEQ ID NO: 1 - DNA, 410846 bp, Homo sapiens
gaattctttaaaattatttaaaattaagagttataagcaattctaatttcatctaatggttcactgaaggctgggctaggacctggtgtctaaatttttttttaaacgatcaaagccttcagagccgagtggccagtcctataatcctaggccactagaaaactgaatttcctgaattttctgaaaaagtttttcaagtagaaagccttctgggatttttttttctttttttttttccagtccccactttggatgtagtaaggcttctaaaggtcaagttatcttgagctaagaacctttagatactttcactttcagcttattccttgttttttgaggtctttttataggtaaagagaaatcaaaacagcttctatctggctccgttaactacttttatgttccatccttgaaattcatttatgtcagcatctgttacagtacatagtatgtagtcatgttttcttcctctcatcttatctggtgtcacttctgccctaagtgtgccctagctaagtccttaggtcttcttggtgtatccctctcttgcttggatataccatctttttgccttccatttctgtcttgaagaatactaaatcttcaaacatattatgtatataactgccttcaggctcttttttcaccttccaatccaggttcttttctatacctagattaatctttctgaaaaacacctttccctctaagaaacaatttccttagtttgatataagattctttatatttctgttcagtttttaaaatttactaccttccagtccatacttgaaccagctacctcaccagattaactactcatctctccctgagcagagctcactgttcactattcacttgtgctcttatgtacagggctttctgttttttctcttacccaagcttcccctttgattgctgttgcccaggaagactccataacacttccatttcccttttcaaagccttcctaaaccattttaggccttagtaatctttgtcctcctgccccattcttttgatatgcatattgcttatcttctgcatgaagattctaaattccttcaaggtacaatctgctcacacagggttcctagcacagtgctccttatgtgataggcactaaatgaacattttgattatttgtaaaatttgggtggggggagattatctttttgactttatacctttaattacctttatgactagaaggtgctttacagtaaaaggagacaatgttgaactatagagccttaaaaacataattaaatgaatatagtttttaggaggactcttctggttaaaaggtttaagtagattctgtgcacaacattgagaagtgttttaaacccatttgtagtctcatttataaaggagtagagtaagaaaacatcctgaaaatccatgtgactgtgagaggactgaggaagcctgagcaaaattgaacaattggactaaactttactgagttctgatgggctctgtgatttatttggggtggtagatttactcatatccttgtgtatggtgttatatagcatcatagtccccatctatgagtcattcattcaaccaatatctgttgagcatctactctctgctaagcattgttctaaacactaagactacaacagatattctgatgaggggagtggacaataaataagcaaacaaatagattgtggtaagtgcaatgcaggttaattaaaatagaatggggtaagagagaatgactgggtagttaaggaagtcttcttggaaatgacatttaaacagatctgagtaacaaggaagtaacatgtcaaaatcagaaaaacattccaagtgaggaaataactgctagcacaaagaccctacagtggagtttcaagaggtagttaaggatgaaatcacatagggccttgtaggcatggtgtggaatttagattttattttgagtaagatgggaagccattagagggttctgagctaagcagtgataaaaagtccctctggcttcggtgtagaaagtagttgggggtcaagggcaagaatgtacactgggaaactagctagtggtataattacagtcactcaggaaagataggagaaaggaggctttcattaaagtggtcgtagttgtagaacagtgaagtggaggtaaagttaaccagatatagtaagagattggatgcggtttagagaagaatcaaggatgtctcctttttgtaaggtcaaccgagaggaagaatagacccaaagtcagccgagtaagtttattgaacctgccggctgctccactacagacagaggaggaagccctgagcttataaaatgaggggtttatattggggagagagaccctggggtcgtttgttggttaactttatcatatatcaccttgtgacatttgtggtagcagctaaatgaaggaacttacaggtaggtgtaggtaaagcttgtttgtgcttcccacgacctccccctgtgcggtcccaatggcctgtaattgggatttgcttatcacagcaaggcctgataggtgaagtctgctggcttcattgtggcacctagataagggcttagaaatgtaaaggggctcagagggaaaggtgggcagcacagagaagagttgcagagcataagggggaggggggtgggcagcatggagaggtttgaggggagcgtcagcagtaccaagattttttggggcagtttgtctctaacacttttgacttgagcaactaggtagatggtagagctttttactgtggggagagaaaaagaggggcaggtttagagaagaaaaaatcatggtttgatattggacttgaggatctttaagttcagtagaggagaaaatgtaacaatacaggtatagttaaatttctataatagaaaaatacctagattggaattatatttctctattgctttataacaaattatcccaaaatttagcagcttgaaaaaacaaacttatagtttctgtgggtcaggaattgagaaccagcttaactgggtaattctgatgcagggtctctatgaggttgtaatcaagatgtcaactggggttgcagtcatctcaaggctctcctgggacttcactcactttcaggttcactcacatggttgtctccaggaaccctcagttcctcaccacatgagtttttccatagggaagttacacacaccgtcatttctgctgtattctgtttgttagagtgagtcattaagtataacacacacacaagggaagggggattagacttcaccttttgaagaaaggagattcagagaatgtgtggacctctttctaaactcacaaagaatgttaaaagaagaaacaaagcaagcctaaagcccatgaagaatcaccagattatagcttgttcctctgattcttatttagtatcaaaatattaggttttacacttgtattcccaggacggactctaaaaggggaagtacagttgcatactcttcatatatgccaagtatctattggagacaagcaattctcaaagaacaagccattccaagctaaaaaaaatgtattttatcatttggttgaagctgtttgtctcctatcactttgtttattaagccagtatcattaggtatcaagtgtattatttaatgtctttctgttctcatcacaggttattgcttacaactcagaaggtaaaagtaatccaagtgaagtagtagaatttactacttgccctgataaaccaggcatacctgtaaagccttcagtgaaaggaaagatacattcacacagttttaaaataacctggggtaagatattatgcatgtttatacattattacttttgcgtttgattaaaataatttgaatatgaagataatttttaagatatttgagtaaatttgttatctcaagccagtccaaaaagaaatgtgagagtcattcattgggtatgttttttgtggaaaaccttatactctcatacatgctaggttaagatatgataaaaaggaacttgcgatccactgtaagataatgagcaggggtagcactgtgaaatgaaggattactgaacttgcagctaaagtcacctgggtcatctggctctcgtaagaaatgaaaaccattcatttaaaacaaacatttatcgagcacctacctacatacctaatggaaaaacaaagatcccataaacttgacccttgcctgaaaaattcagaccaataaaaatgcttcagtgatatttataatattcaaaaatttcaaacaaccttaacatctaaagtaaatggaggctgggcatggtggcttacgcctgtaatcccaacactttgggaggcccaggcgggcagatcacatgaggtcaggagttcgagaccagcctggccaacatggtgaaaccccgtctctactaaaactacaaaaattagctgggcatggtggcacatgcctgtagtcccagctactcaggaggctgaagcaggagaatcgcttgaacccaggaggcagaggttgcagtgagtcgagattgtaccattgcattccagcctgggcaacagagtgagactccatctaaaaaaaataaataaaaataagtaaatggaatatcatgcagccattaaaaattgttatagagagccatattttaaatatggtaaattaagtgaaaagcagatgacaacagcatggagtaattgggtactggtattaagtcattgcaggtgattttttttttttaaacctagtttggtattctgtttattaggttttttttatcatttttatgttgttttgtaccttgcctaatactactttgcttctttggatagatccaccaaaagacaatggcggagcaaccatcaataaatatgtagtggagatggcagaaggttctaacggtatgaatggatattaaacactgatagatttattccagccagtctctttctattctttatggctttacattttatgtcatatcttttctttcttcttgcttttcataaggtacaccataaaaagatgttcacttcactttgggttgtcctggattttttttttttaatgtcataagtttattgacaaacatatctagtatgccatatgagttcaagtttgatccacttccagaggctgtacctcttaaaatgctcttcatatctgttaatggatgaactgaaacatccttatgttttaagtagttgttgtcttactacaagaaagggtgtagcaaatgcagatccaaagtacaaacacatcttagctagtaacgaccacttgttttccactgaaaatggcaaattcttcccagggccctcctcacagtggctcctacggaccacagaggttgtgaacctccggatgctctggcccaacgtagcgctgctggaagctctgcgaaaggcacagaaaccgaggacggatgaaatggcggcacctcaccaagaccttttttttttcctggattttttttttctttgtttgtagcagttaggattttgcctgttatgatccactttaaattgtgatttccagaaatacagtgaatcaaatgtaagagtgctgaacaactgtatcgttgcatttacatgttctttttgttctcatttatttacattgctcagcctctatacacctagaccaagtcattagatactatgaatcttctgaaggttagtttattcagttagatttatatacagatatatcagagaaggattaacttctaaaatttaactcacatcatactagttttagtagtaagttttatgactagtgaactttattcttgaatcacacatttagcagtgtttatttctatgaaatgacctatttcctgccaaaaagaaaaaaaagatgtcttttaattaggactagacttcctctgatactggttttttgtactctttgtatgctataacgttattactggaccagtaaacacatttaaaatgcttaattaaaagtaaattatcaatctaggccaaagtctgtacagagttacagagatatttcacttccacaaagccatgcagacttgtctaggaagctgcacacataaagaaaattagatcatttccaggaaaccgaaacaaacctaaattgtttctgacaaattacacaaatacttactttgtgaagctaggatacctgatgtgtccatgataccagaacgttaaacattacctagtatctgattgaacacaattcctcaccttacaggaaacaaatgggaaatgatatacagtggtgctaccagggaacatctttgtgatcgactgaatccaggctgtttctatcgtttacgagtttactgcatcagtgatggaggacagagtgcggtaatacttatatgtagattcttttgtgttgttattaagtttggccaaatggggtaggatcaccaggtgccacttcaaatattgaaacatatccacaaatggagaaaagtaacttctgtaacctgttgggttaatttgatagtgaccaaaatattctaatgtggtacttagctcacagtaagtattcagtgtgtgtctgttgtctggttggtattcagctttggaaaaacaaatacatgaaaacattggagaaaattttataaagataaatttgagaatgatgctcaataaccatactaagcagagatagaaataaaataattatagaccgatttactgctccataaattatgtgtgtgaggacacatcataaaatagtatctgctgtttaatctactttctaatatttacttacttcaaaaaagttggccattattttattattagagactcaataaccaaaatgaacttaaaatgtaccattgatataaagacataatgttctagggatgtatgtttattaatgagtgattttttttttttttgggaaacagtctcactctgtcgcccaggctggagtgcagtggcacgattggggctcactgcaacctctgcctcctgggttctgcaacctctgcctcctgggttcaagaattctcctgcttcagcctccctagtagctgggactacaggcgccccccaccacaactggctaatttttgtatttttagtagagacggggttttaccatgttggccaggctggcctcgaactcctgacttcgtgatccaccggcctcagcctcccacagtgctgggattacaggcatgagccaccgcacccggccaagtgattttttttttttaaatgaattaaaccaagaatggtttcttggatcattcataattgctgggttttttttttgaaatgaaatttaatgcaatgaaagtattcttttttaaaaatgaaatataggcattttgttgaaaatgaaactaatgtgcaactgagtgtgagtcctgcccaactggcttgtgctccagttgcttcattttatccagtaagaaaatctccctggatttcagaaaagcaacaacacatagacatgcacaaaatcctgttctactatagcattttacagcatttttacatagatagctttctgataaaaagatgaccaaatattttgtgtttaaaaagaatgttaagtatgaaccttaatatgttgcaagtaagtaatatgccactgagtttgtggcattgttttttttgagacagagtctcactctgttgcccaggctggagtgcagtggcacgatctcggctcactgccagctctgcctcttgggttcacaccattctcctgcctcagccttccaagtagctgggactacaggtgcctgccaccatgcccggctacttttttgtatttttagtagagactgggtttcaccatgttaaccaggatggtctcgatcttctgaccctgtgatccacccgcctcagcctcccaaagcgctgggattacaggtgtgagccaccgcgcccggcccagtgtggcattgtttttaacagagtgtctttaaaaataaaggctttttaaaatataaatatagcatagaaactaaaagcagtatcaaatacctagaaagatgccaagtaactggaaaagcttacctgattttagaattatttttaggtggaaaggatgaaggaaagataatcttttaatgtataagttaagcttggtgcagtgacaaatgtgtatagtctcagctactctggacgtgggaggattgcttgagcctaagaatttgaggctgtaatcatacctgtgaatagcaactgcattccatcctgggcaacataccaagaccccatctctaaaaataaataaataaatcagtgtttaggttaaaaatacagtctacagtagtaaagtagccaaaatattctaaacctccttacaacaatacaaacagcatatacagtattttaaaacatccctccttagaagagatttatggatccttttggagaagatcaaaaatattgcccattaaattgtgttggaagttgtttttttctttagttatggaaagaaaaggaaaggaagggttcattgaagttctttttcagtaacttgctttgtatatagtagttgcacagtacatgtctttctttgtctatgaaaattttgagtttttatttaattgggttttcattttttttcagaactttattccttttttgttgacaatcaagtacaatttcaaattatcagtgcaatatttgtgtttatattatttttccttaccaaaagcaatctgattatttggttttggggcatttttgttttctttttgcttttgttttggcaggtctctgaatctttacttgtgcagactccagctgtgcctcctggcccatgcctccctcccagattacagggtagacccaaagcaaaagaaatacagttacgatggggtaatttccattttggtaataaattataattaagctagaacaggaagtattcgtcttgttaaattgcattaatctttccatcttttaggaccccctctggttgatggtggatcacccatttcctgttacagtgtggaaatgtctcctatagaaaaagatgaacctagagaagtttaccaaggttctgaagtagaatgtacagtgagcagccttcttcctggaaagacatacagcttcagactacgtgcagctaacaaaatgggggtaagaagactgtgctggtagaattataatcacaatggtgatatatgtttcattttaacatatatcatcatatccattatttggccatttggctttaacatatgactccaaattttacaatttttaacaagcctacattgataaatacaagagaagtcggtatattccataacttaatttttatgaaatctcagtatttttagatcccacttacagtttgtgacactttggacttcagctgggctagagtttaccttttaggcagtgttaatagagtttacttaatcaatttaagagtagaaataaaatcataagtactgaagttttttgaggctgattgaagtttttgaggtttttgaggctgattgaagttttttgaggctaaagtagcatttactttcagttggcaactaattatgattcattttttttgcccaaatgaaaaaaaacttatgcttgaaactattctggttttgtatgtattttttgaaatattatctatgtatttaatatataactccaaaaagtggacaaagtaggtgatatctccatttcacaactaaggaaacgggttcaggaaagctaaatattttgcccacagtcatacaaactaataagtgatagaggtaagcaacaaaccttagtttgtcagactccagagccaaagctctttccactcagctatgacacctctcatctctctgcaataaagcaggttccctaaggacaaagcagtaatttcctatctcagctaaataacaatttctttcaactattgtataattaaaatttttatagaattaaactgacagttctctcctacccattattttggtgaactatactatatttcaaatcctgttttccaacagggttctgtatttacatctgtaaacttatttttcaatttatttctgtttgattttttgaaacagggtctcaccctgtcacccagggtggaatgcagtggtgtgatcttggctctctgcaacctccgcctcctgggctcaggtgacccttctacctcagcctcccaagtagctgggaccacaggtgtacatcaccacacctggataattttttcatatttttagtagagagagggttttgtcatgttgcccaggttagtctcaaactcctgggctcaagagatctacccacctcggcctcccaaagtagtgggattacaggcaagagccactatgcccggcctaaatttcttatatgtcaaatttatatacttaggctgctcttacacaagtcattcctttctgtaagaagccatcttgtcagcctcacaaggctgcagtacactaggatcgcatctttaatacttacgtcttaatttatattttcaggtttgtgataatttgtcaaaatcaccttaagtaaatatttactttccgtatttccagagaacatacattttagacctttctaaagctattccagattttaagataaaatttatgcctaccagagagcagtactgataaataatgtactataagtacactatttacagttttattttaaataaaatccattcagcatgctagaatggtgaagctttgtcattattttgttgttgtcgacatgaattaaccttgttcaaaaaaggggggcaaaaaaatgacatttgtcatggaaaactttttttaatccctataggacttgaggaacagaatccttacttcagttcttataaatagttgtgctaaacctcaagtttctatcatttagtggccctttccatgctctccatgaactaaactgaattatctgtgtgactgatatgttttcttaggttgccttataacatgtataacagtactctttatttgtagatacctttgtatgtatgtgtgtgtatagacagatagacagactttttttttgagacagggtatctgtcacccaggctggagagcaggggtatgatcatggctcactgcaacctcaacctcccaggcttaagcgatcctcctgcctcagcctcctgagtagcagggactataggtgcacaccaccataccaggctgattttttacttttttatagagatgggggtccccttatgtttcccaggttggtctcaaactctcgggctcaagtgattcccccaccttagcctcccaaagaggtgggattacaggcatgagcctctgcacctgaccttttatatatacttattattgtaaatcatttgctgccactagcagtctgtaagtctatactattaaatgacatattggccaggcatggtggtaaatgcatgtaatcccagcactttgggaggccaaggtgggtgggtcacttgaggtcaggagttcgagaccagcctgaccgacatggtgaaaccccttctctgctaaaaatgcaaaacttagctgggcatagtggcgtgtgcctgtaatcccagctgctctggaggctgaggcaggaaaatcacttgaacctgggaggcggaggttacagtgagctgaaatcatgccactacatccagcctgggcgacagagtgagactctgtctcaaaaaaaaaagcaattaaaaacaaaaaactattaaatgacagatttatatttggaattttggctaggcacagtagctcacacctgtaatcccaatacttggggaggccgaggctggcagatcacttcaggccaggagttcgggaccagcctggccaacatcgggaaaccccatatctactaaaaatacaaaaattagctgggcttggtggtacccacacctgtagtcccagctactcaggaggctgaggcacaagaatcgcttgaacccaggaggtggaggttgcagtgagctgagattgtgccactgaactccagcctgggcaacaggctttttctcaaaaaaataataacatatttggaattttaaaattgattgggttttcaaatttattgttttaaattaggaacttttgaactactaataaaactatctgccatagttcattgatttttacatgaaatatttattttcaagatggtttcaagattacttttcacaaagcaggcgcattatatcaccattttgctctgccttgtaaacttgccatctgggatttttgggtggtattcatgtgagagtaaagcatattctctagcagtttcctatagctacaggtttgtttgttttttttcattgcttctaacaggatatagttactatgagtccatgaaatataatggaaatgtgaataaggagtttactgaagactttaaacatttgatttttttttaatcgtgaatatgatagaaactggtagtgttgagcagtgcaaatatttgaagtggtgatttgtgaaatagcccagcattgccttaaacaaaatcacagtctacttcttgttttatacatatgatagtataaaaggtttcttttttttcccattttctgagatttatagattggtatatagctttaaactatataaagttttatggaaagattttttaaacttattaatataaattttaaagttgatataattaaagtgagcctatcttctgtttataaaatgcaagattccttaacatttataattatacagatgaaatagtttctataaggaagttggagttttgattttgccctttatagatgttagattgtgcagatttgtctgtattttctcaccatatcaaataatacttttattataagattggttttcaagagccgtattagttgttataattgattagtatatagtttaactttattcatcatatttatactgtagatttatggccagaggttgaggttatttcaggagagttgatgaccttcatttaaagtctagctaaaatcagtgctgtaaacaaaaggaaacatttacgtttgtttctgtttgccatatatagtagccttgattttttacttttttataaaacagttacgttcacaatattagcctgaggtattaatgacattgtgatgatacaaaatggtgtatattccctgtgcaatcggatttggaggaaaaatgaaggacttaacattatctgaagtcactgatactctgaataagtatggtcaaggagtgaactattttcttttggaaaaactttttaaaattttatttttaaagtattatactgttatttttagggcctaatggttacattgaatagttggtttcaccttcttaaggttttttaccaatattcatgaaacttgatatttttaaaatccctaccctttggtaagtcgttatttattaacatttttattggtgattaatacatgttttttcctaaattaaaaataaataacttggaataattttaatattaaatatttgttaacaactgaatgtttccatagaattttctgagaagttgagtttcttagagttttcgtagctggctgggcccagtggctcatgcctgtaatcccagcactttggctcaagcagtcctccctctgagacaggaggaccacttgtgcccaggagtctgagaccagcctgggcaacatggtgaaaccctgtctctgtaaaaagtagaaaaattagcccagcatggtagtgcacacccgtagtcccagctactcaggaggctgaggtgggaggatggcttgagcccaggaagtcgagggtgcagtgagccatgtttgcaccactgcactcctgcagtctaggtgatggagccagccagaccttgtctcaaaaaaaaaaaaaaaaaaaaaaaaagaagttgagctagctcttaaagatgggcatttggcaaaactgcctgatacagtgcagtaacaagtaggtttacttctgaccattataatgatgcgccactgttaagtgaaaataccagtgtattggggcttttcttttgctaatgagctttgaaaaattgatgacaagaaatttctgtaattgttctcctatgtgtcggggaaggaatttgccaatactgaataaaattttttatattccgggtaatgtatgttaaaagtaattatgagaaagtgagctttttagcatggaacagaaaaatcaaattctgttacaaaataaacaaatttatagaacagaatgttggtaaaatttgatatggaatatgcctaagaaagattcgtgaagtattaaaaaattaaaaataataatttacacctaccatctcccgtacctttaattagtatcaatttcttcactccttatatttctcctgaattattccaccgacctcattccctaatgtcctgcccttcttacaaaaaccatttcctgaagaaataaggggcagaagaaagtataggtaaatgaaactttaaaatttctcacacctttactttcatgatttttaagtctttttagttaatgtgaatacttatagaattatgaccaaattaatcttgaaacacagggaaaagactttattaatgaatctttaaatatgcagttctgtgcaatcagtggacatttaagggtgaaaaataaaaacactagttacatttgtttttctagtttggaccattttcagaaaaatgtgatattactacagcccctgggccaccagatcagtgcaagccccctcaagtgacatgtagatctgcaacttgtgcacaagtgaattgggaggtattgtaatttccattgacttgtatctactttcttaagtgaatagaatagtttatataaaagaataaagatactgttcatttttaccgcctatattatacagagtaagccctagtttaattcacatgaaaaacagtgacttctttttcctctttgaagaatttgagtaaggtatatttgcattacaaatatttagattcctgttcattatgtgctttgtatttttatgaatggctttgtctcagtactgagatatttcagccactgtaagtttaatgttcagaatagacatacacaggaattagtaaattctatttctcttatatttatccagtacacatctccagtgtacttattgtggatagtaataatcagtgatgataattattatattttcagttccctttgaaatttaacaaaatgtgtgtatgcttttaacatttcatattaatagaattatcttgaaacatatttaccttaaaacactctttctaaagtgacttagtcatatttctacttctaattcaaaacagttatatatttgaccaatcttaaattcagataatcttaatgaataaaaaatgtaaaattgaacagttttgattgtgcttaaaagttttaaagaaactcaaaagcaatctagttttacatgtgctcaggtaaagagcatttttggccaaaagctatttaatcaacatcaagactaagacctttatccttttcttaatttaaaggttcctttgagtaatggaacagatgtcactgaatatcgactggagtggggaggagttgaaggaagtatgcagatatgttactgtgggcctggtctcagttatgaaataaaaggactttcaccagcaactacctattattgcagggtccaggtaaagatgatcagtaccttgtcacttaactctatccagagttttatatttcattggcattttcatggtcatgactttgttaactcggaggctctgttaatttgtaggctctgagtgttgtgggtgcaggccctttcagtgaagtagtagcctgtgtgactccaccatcagttcctggcattgtgacctgtcttcaagaaataagcgatgatgagatagaaaatccccattattcaccttctacatgccttgcaataagctgggaaaagccttgtgatcatggttcggaaatccttgcctacagcatagactttggagataaacaatccctaacagtgggaaaggttacaagctatattatcaacaatttgcaaccagatacaacatacaggtatactctaaaaattatgttgatttttgcctagaccagagagacgctttaaataaaacaatcataaccaaactttttttcttatgtggcacttagaatacgaattcaagccttgaatagccttggagctggtcctttcagccatatgataaaattaaaaactaagcctctccctcctgatccacctcgtctggaatgtgttgcctttagccaccagaaccttaagctgaaatggggagaaggaactccaaagacattgtcaaccgattctattcagtaccaccttcagatggaggataagaatggacggtaggtttttttaattgcttctttatatagtttcttaggtcttaagtatatacatttctgtaactattagaagtaggccaggtgtggtggctgacacctgtaatctcagcactttgggaggctgaggcaggcgaattgcttgagcccaggagtgcaagaccagcctgggcaagacagtgagaccttgtctctaaaaaaaatttattttaatgaagtaagttttcaaaaacgaagtcaagattgtcatacaaaagtgtgctgtttttaaaacgttagaaaacacaatgtacatttcctgtttataatttgtgagtggaataccaagagaaaaaaataagtgggctactgtttggttgttttctgtaatccatttactgttttcatgatagtaaaagacacctaatcttagatacaaaataaactcttcagtgtttatttctagcaggacacaattttttttttttaagacaaggtcttgctctgtcacccaggctggcctccagtggcactatcttggctcattgcaacctctgcctccagggctggagccatcctcccacctcagctccccaagtatctgtgaccacaggcgtgggccactacacctggctaatttttgtatttttagtagagatggggtttcaccatgtcgctcacactggtctcgaactcctgggctcaagtggtcctccccgctcagcctcactgagtgctgagattacaactcatgagccactgtgcctgaccgaaacaattttttttttttttttttttgagacggagtctcactctcaccaggctggagtgcagtgacgcgatctcggctcactgcaatctccgcctctcaggttcaaacaattcccctgcctcagcctcccaagtagctgggactacaggtgcgcaccaccacgcccggctaattttttgtattttagtagaggcggagtttcaccatgttggccaggatggtctccatctcctgacctcccgatccacctgcctcgacctcccaaagtgctgggattacaggcgtgagccactgcacccggccctgaaacaattttatagtaaatgattatgatcgttcctggcctctgagatccttgagggcagagattatgtttcagtcttttccagattcctgacacagggcctgcacgctaaatgaatacagttcagtttttcactgtgtgatctcagttagattctgtgattaattatctagtccctttgctaatcactgttgctaatctttgctaatctttgaattagaaagaacctaatttcattcaggttctttctgtgcctctttcacatcttcatgtacatgttgtactattcctatataatgtgccatatactgccacactaaatcatgtattttaattacagtgttaactctgaatatttgtaacagtcattctaatgccaactagggctatttattcacattatattccatataagcaatgccacatacctcccacagctgttaatcctttaatattttaagaattttgaattttgcttttctacttttcactgaatatattagaaacaatttccaaatctgatggactcagaatactagtaacagtttttcccaagatttacttttctgtgttgtttgtatcttagccaggtattcaacaatgaaatattcatggtgcttgtacataaccactctctatcagaaatacttatacatttaaaataacatatggaataattttgtatactagtatatcaccagtaagaacattacacagaacaaacgtgatcatttcctaaaatctgtatcgatgaatgttagcctttgttcttggcagaattttatgtaatctttgtagccttatctctacaaagagattatttgccttgtacaggtttttggtatagccatttatctttaatatatgttattattactggacaaattaattgtttaaatttttttcctcccctttctagcatacatttggggtagtgcaagaaggcttactggaaacaggtctaattagtgtttggttgaaagataatagaataaagattctattagatataaattctattatagaacttccaacttaatattcagctagcatctagagaattgttatggggtatgaatatggctcatggcctttggttgtggaaaataaagaaattaaaaccttttatgatactgttaagtttaatgcacacatttaataaattaaatcaatttaatatctttgattactttcattccctttgattttcacaactatatacacttgctgtgggatggtatcataatgatactttagttgttccctgatccagattttgtcattgttcagcttttttaaacagtggtattaccactatttttttttcctgtcattaaaaaaaaatttagaggttgaaaaggcaaggcttatccaattactgcttattggaagtactgtttcttcctgtcattaaatatttctttatttttaacttggctacaattttcagactgttagcattgaataagcattcattattcattctctaatttccaaaaattttagaaacatccaatcaaaaataatgggatgcattcaacttatagataacatattaggagaaatatgtatgatattcaacttcattgaacagttcaagtgggtaatgtattggaaattttatattatcatactgcttttgtaaatctctaaaaaaacgtcaccaagtcaactaaaaatctgcctgggaattgagaattctcttttttccagataaagacaaggaagattaaaatagaaacttaatctcatagctcaggtctctatgccatacttggcaaattttatcaatatgactttagttagaaataatttgtaatgaaaattgtgatgttctgagcatcttttaaaatgtacattaacaaaacagtattcagaaacaaagctaaaccggaagcctgagaagaaacagttatggtcggacatgaaatttagtaacagacttttggtaaatcatgtcaaattgggaaatttaccaaatatcctatttttcttaatctgatgaaaaacagatttattttaagtgacatagagttcctggcatcaaacttttggggtaacttatcactcctaaataatgttcataactgtgtttttatactagtttgtaaaacactttaataaggtatcataaggtagtataaggtttatctaatagttatttccattttaggtttgtatccctatacagaggaccatgtcatacatacaaagtacaaagacttaatgagtcaacatcctataaattctgtattcaagcttgtaatgaagctggggaaggtcccctctcccaagaatatattttcactactccaaaatctgtcccagctgccttgaaaggtaagttatacatcctgaacttattttctttataataaattactttttaatgtattttcataaatgctttgtttactgatattaaaatttagcatccagtatatgtccaccagttatacaaaatcgtataggcaagcccaactctactgagagttccactcaataataaaagctgttttatctggcacgctcatattcagacaagtactggcttttgtcactgatgtttttaataatgtagcataaaaatactaaattgaataggaaggctggttttctaatgaggtcatttgcttaaagaaaaaaatcacaaactctggttgtttaaacgttttgagttattgatattacattcatttggatttcagaaggaaagcttggtcatctgttaagcaaaacaaattcttcattaatgtgggtttttcaattagttttacacacacatgtacacatatttacacacatttgtatatacatttatcttttaattttagaggggttcttattttaaagtgactctggcaagggctacactctatttttagctgaaaagtctataaagttaattgctctgaagactaatcacagagacttctagaaccatatcctagatcatgtacttaaacctatcatttgttaaacagcagaactcttcttgactagtctttctaataatattgagtttcactgagtcatttttctgtttgctcatcaagtttagtgtctcttagctttaagaagagtgctgactataagcagggcacagtggctcacacctataagcccagtgctttgggagactgaagtgggaggctcacttaaggccaggagtattgagaccaacgtgggcaacatactgagacctgcctctctacaaaagaaattttgaatcagctgggcatggcagcatatgcctgtgtgtgtagctgcacaggaggctgaggctgcattgagctatgatcgcaccactgttgtccaggctgggtgacagagtgagatcccatatcttagaatacaagagtgctgattttaacctctttggatgcaaatttcaaaaattcactgatacttatttcaagtttataagtggattttaaatatttgttgatttttattaagacaagtgtctgcatgatgtaccaaattaaaaatcaagtggaacagatattatttatatttgtttcctacagcccccaaaatagagaaagtaaatgatcacatttgtgaaattacatgggagtgtttacagccaatgaaaggtgatccagttatttacagtcttcaagttatgttgggaaaagattcagaattcaaacaggtatgtaccaagatattaatgtgtggatgcatatttttacccttttttaatttttatgtattttcagtgtaagatttggccatctttaccttttaattcataaatatttattcagtatatattatgttccagagatctcaagattccaaatcttttcagtatgaactacacttgaacagattattcatttatctgataagtattcattgaattctgtgccaggcactcaggatatagcactgaacaaaaagtcccttgcctccatggagcttacttacattctggtggaaaagaagacactataagcaagtaaacatgacaatatattgtcagatataagtgtaatggagaaaaaacaaaattggataaaagaaatagggagtggagggggagggcactgagtgttatttcatttggggcactcagctgacatttcagcatggcccagaggagatgactatggagagaagagtgttccaagaagatacgctgaggcaggaacatgcctattaaatctgatgaacataaaggagccaatatgactggatggagagagcaaagggaagagttgataaggtcggatagttaatcctaaggggcctataggtggtatggagtgacgtaaggcataataggccatactgtggcttttactccacgtgaaatgagaagacagtggaggattttgaccagggtattcacgtgatcagacacaacgttgttttgactatagtgttgaaactacagtaggacaagggcagaactagaaagactaataaggaggcttttacaataatagtattaataatagtcataatgcagtgctgtaaatatgacattaggcatgaagttataatggaaacctagaggaattgtcaccttcctagccaagaggtttcaaagatagctttctgataaagcaagaatagcagtgagatagagtggagtgttgccaatgtttgttacaacttttaaaaagaataagcttttataccactccaaagactaattaaatacctatacatttcacctgattttccctttttcctgtaaccttaattttgagggcttttaagctgggttgttttcattgtgtcttatattttcctcttccactaaaaaaaagatccttcatttgttttattccagtattgtgctattgtaaccactctatgtaatatcttaactgaaattacaaaagatccaaagagtcagattaaatctggcatgcaattgtttttctttattaagccatctgcaaattgacaggataattagatttgaaatgtaatttacagataagtaggtttccttctaaggaggaagcaaaattaatattaaagaaaatataattgtattacacgtttaaaggaaatagggattccacatttgagtagtatatgaataaccttaaggcttgtttgaatgacttttcttgggtgtataaaccttctgaaattagcttgagcaggttaatctgttttcttcagtcctgtatttacagttacctgtgtctcttcctgcttagaggtcttcccacatctgaaatacaaaattgaaaacttgatcccatcatcttccctcccagtatctcctctccaacatctttacttcatcagtgtcatagacaccaatatcatcttggtctccaagctttaaattcttagatgaatttttttttcctatcaactcttaatcagaatttgtttctaaatccataaaactacatcagggcctcatcactttttacatgtacatcaagagtccctgtcctactcagctcccttcagtccttcacacagcctcacgattaggattccataaacactgttttaatgtcacacacctacagtggtcccttttgaattaacctaaatttccaactagtgtaattaatgtattcttcctctttgtaccagatctcttatcaccctcatgccatttgttgaggtttttctttcttaacctaatactgccaggctcatggaatggtatatgaagacacatggaaagtataaagacaaaaatcatctattatatccataagacaaatacatatttttaatttttactcaatttacttcagtgttatgtatacaattttacactactttatcatacaacattctgttttaagtgaatccttttacaggttgaagcatcccaaataaagtccaaaattcaaaatgttccacccaaaatctgaaactttttgaggatcgatatgacactcaaaggaaatgctcattggagcatttccaatttcagatttttgggtttggaatgctcaactagtaaatatgcaactattccaaaatcaaaaaaattgaaatgcttctggttccaagcatttcttataagggatacccaacctgtaccatctcccaaacatggatcatttctacattctattccctgaaacattatgcatccttagaactaatgtatagtcaccattttctttcagatttatcttaaagcttctttcagtaagttcctttatatattgttatcagcatccacatttttatttattgccaataattcactaatttaatgtccttttattaagtacctactatatgctagattctggagacagaaaaatgagacagagatcttactttactttgagagcaaagcaatatgtaaaaatttagatttacatcacaggtacaattgaggcagctaaaagtacttgaaagcccccatgtgttggttcttctgacttgtagcccaccaactaactggagaaactcaactgacaagtcatttaaccctatgaaccttggttttctcaattacagaatgagtggtgggaggttgctcattattggaaatgatagctcctacagattgagcagtgactgcatgctgagcactgcgctaagtgctttaacaagcattagttcatttcatcctcataattatcatacatgttaactactagtatgtctgttatactaaggtagttggtctaaaatcacatctggagtgtgaagtggtagagcagaccttggatgccaggggtgaacagttctagtatatagcttcttatttatgcctagtgttccattattggaacactaagcttgtggtagttatttatatctcactgatcaaggttattgccaaggtctgatttttcacaaaaaaaaaatttgcaacctctggcataaatgggttaattactagcacattcctctgaaaatccgtggaatttcattctttttatttcccttgtgaggcatggcagaggaggtcctattttctgattctaagtgatctcccctctctggtttatacagtgatttgccataggcacctatagaaagctccccttattcattttccatttcattgtacagatatgtttgaaattatatggaaatttatcagttatacaaagacataatgggggaagcaaaagtagacactatcccttctttgatggaatgattgcattgaaaaatgacttcttacatttgagaaaagcaagaaaatgcttgaggaccgattttgcttgttctctagctgccctggggcacatctgcactccttaattcatctgtgaaccgtataagggtagatcctcgcttttgaaatttctcttgcccctatgcaacaaacagataagtactttaatggacaggtatttttaacatgtcatttaaaagataaaatcaatggcattcactggctttcacatgaaaaacaattctaacactagccagttttaacacattttctgtccagccttcacacgtaattcttccttctaatattttattaacagatttacaagggtcccgactcttccttccggtattccagccttcagctgaactgtgaatatcgcttccgtgtatgtgccattcgccagtgccaagactctctgggacaccaggacctcgtaggtccctacagcaccacagtgctcttcatctctcagaggactgaaccaccagccagcaccaacagagacactgtggaaagcacaaggacccgacgggcactgagtgacgagcagtgtgctgccgtcatccttgtgctgtttgctttcttttccattttgattgcctttatcattcagtactttgtaatcaagtgaaaatataactttattttttaactctattacattttattttgtcatgtactaaaattatttctgtattgcttttataaaaaacagtggcatttagcactggcattgagactatagcacatcatttttgccattttcagtgcttatattgttaggtagaggctggcactttattagaatgcaagccacaaaaatatcaattttgttttttttgttagggtgggtcttctttttttctttccctctctctttttttaacaaatgccttcttatagaaaaactttctaagaggcaacaatttagaatggatattttgacgaatcggcatgagtgtaacagtgataacctgatctgtttgttttaaagattattaccaagtgaaaaattcagaatgaatagaatttacactaacatgctatataaaatgttaaagtctgatgctgtgaaagcaatctagtgctatatttctacctcctcatttgtcttaattatttggtaagtgggattatgatgagtaactggaggggcttagaaacaaaaactggatgaaagagtatgcatgaagaaaagcttctttgataaatgtggagttcttcattataaatatatattcatgaattcacagataagtacttaaagaacagacagtttacttggcctaaaaatattttgatgtttactcaaaaagtacctcttcaggtcttgagaacatggaaaagaattgagtgcttttaaatactttttagaaagtaatcataaaagtaaattgaatttcaaacctatttggcttctgttttgtgaacctttgaactatatgtatgtgtataagggtatacacatacatatatggcatataacaagtgtacacatatacacataacaagtgtagaagtatatattacatacatacactcactctgtctggtataggctaattttgaagaactcccataagtttctgctgcttctcccataactgctgccaccaccatcagaattcataatcaaacctaacctttttgtttggggcaccaaatctgaagacaaaattaatttgcaccagtaaacttcaagctgctttctttcttgaaaactaaacgtttaacgtataatgtctgtttggatactgttccaaattgttgattgcatgtggttaatgttgcattagagcactttgcaattgcataattcattaatgttttgtgagcttgcatttgtgagttattggatgatcagactgaattttgtcaagtatcacattgtacatcttgcctagatgtcgatgactgcaagtaataatacagtttataatgaaactatctacaattcttgttttagcacatctgttatccgtaaaacacctgtaactagcttttttaatttattatttgaattttaggatagcgaatcactaatttttagttgctgaggttggcattttagtgattattaagcacttctgtcagtctttgaaaaaagaacgtattttttgtgctttgaagatctctgaagaatttcttttataatagaatgggcatgtattgtaacagttttatgtcaaatgatctgtgctgtagaaaaacattaacccttgttcaaaaaagaaatggataaacttggcctttctaagtggtaagaatgacctgtcactataatatactgtatgtttacattttatttaaatttaatctcttatgtatagggtgataaccttccccagaaacaacagtgattgcgattgttttctagaaacttctttaaagtgccacatttggcagtacaaatgagtctgagtgtaatagcccagagatttatatatagttgaatgtctaaaatggtaaaatgtgccactgtgtcaagttacagtggcttatgtttttcatagtaattcaaatgaacttcctatttttgatagtaaatgtcatttaatagtatacttgccatttgagcctcactgcaaaattagtgcagaggagaaaacaatttttaatgtaatcttgattttacctcatatactgtacattccaaaaactctaaactttttaaagattatagatacactaccaaacatatcaccttaaaattgtataaggctgaatgaacttcatacaaatgaaaaaaatctcataaaaatacataaactatgtagcaaaagtatctgtaaaatccatggaaaataaaagttgtatcattctttttgagatacgtttattgtattcatatatattcattatttgctacctgtttaagaaagtgaaatgttatggtctcccctcttccaatgagcttaaaacatttttcccaacagtatataaatcttcaacatgagaggatgtatatttattatataaagcccagtaaagaataaaattagaagttttatcctagtgacttgattttgtgcaactcatgaaatatcttacttcctttccacatataaagaatacagtgagtctaaggtaaacttcccagtgggaagaaaatccctaacctctccttgcctttcccacatccctattttctagtaccttctttcgcccaccaccagaggcccagaaccttcctggtagtggcactgctgggtctgccttccaccagaaaatccaacattctctcactcatcccccattaaaatttccatcccaagaacttcctcctggggatggacactcagtgcctttttttttttctttttttaatgggtaagctagtaaattttatgttataaatattttaccaccataaaaaaatcattgaaaaattcactgaagaagccaatatggaaagaggagaactcaatgtttaaaataaagccaactttttttttttattcaagaggtaagtacatagcttcaagctcaaggtctaggttgaggacaatcatgagtcctattaaaggacaaccagtttaaagaacactgtcaggcaagctaccacgtagctctccttcactccaggcttagctgttccagacttcccagtactgatgaaggatcatgtttttgttcagctttgcccagtgctgtcattcataatagataaatgaaaagtcccagaaacctgttgtgtttgggaaggttttcttttgttccaggcttcagtggttaatatgcttgacaaatttcagagtctctatctctgtagaccaatgccaaagaattgctttctggattcactgttagcagctcttcgtcttcatctttggcaatgtaagaaaaccaccatattctggcccccagccttcacagccacagtggagaattaagtctagggcaaaatcagccttgccatggtcacgaattaaaagtgtggtgaccagtcttccaacgcctcagttccctttggcatgtgggaacacctgattcattctttgtttcattttcctctgactcggtctgtctgctcatggctctgttggccgttgatgctgatggctgcctgattattctctggctcaggagggctatggccagtcccttcctcagttctatcagcagcagaggctgctgcttcctcttttttgtcatccatctcatcttccgaaggggccaagaagtgaagcttcaggcctgtgaagttggagagcagcaagaatagtgcctcagagcaaaataacttcatgcactccttcaatatatcaggaagcttactctcctcagctttctcatagaatcatcttttgttggccaggcacggtggctcatgcctataatcttagtactttggaaggccgaggtagacaggtcacctgaggtcagtagttcaagaccagcctggtcaatatggtgaaacccctgtctctactaaaatagaaaaattagctaggcatgatgccaggtgcctgtaatcctagctactcgggaggctgagacgggagaattgcttgaacccaggaaacggtggttgcagtgagccgagatttaaaatttaaaaaatgataataaaaaaaaaaaaaccttttcttagggggacctcagctgctctcttccacatctccattctccaaggcctcacagacctttgcaaatttctcaggcttaagaaatttcttaggagaatttcagaactttcttcaaactcttcttgagtttgaatttggtaatccatgtccagataagtaaggttgatccaatcaaacaatttcatgttcttgtggggtgtgagggctccaagatatgagggggttcaaagtagttgggaggcctagtcagtgaaggaccatgaaaccagccacttatagacaaatgtgacttcagacaggactttggacacctggtgaaaggacactgcagatacttcaaagaaaaccagtttgttccataaaggggtaagagacgacaatctgcttcggttgaaagtgttcatcaatgttgtacaggtccaggataccctccaggctcctgtcccaggaaagaaccaggtacaggataaaggcgatccagcgcccttctagctcatcatcatggcacagcagggcatcagtgaattcatatttagcacaggacacatcgatggttggttccagtaaattttagaaatgccagaaagccaggaccagaaatcttcaaacagaattttccttaaagcagagatgtgaggccctcttctttaaatcatcagactgctggaacttacataaatcattatacttgtcatggaaatctaagttcataagttccttctgaagcccttccaagaagtcgtctttggatgaagtttgggatcatgcagtgaagaaaggggtccatgtccctgacaatggcttcgtagctccaggcctcaaccacctgctttttcaaggtttcctccatgacggcatctgaaaattccgccatcacctccttctttcccttttttcccacccgggtccggccgggctccactggccgtttcatctcctcacaaggtacagagccacgccatatgactcagtgcttttaaaatccatgtagatctcttaattgccacaactccaaggaccgtgatagagtttaaaatgttgggctggggaaggagagtccggaaataggaacatcacagaagcagctaagcatgagtccaggtttgagtggggtatgatactgatttgacagtatgattgcacgtcacctcttttttttctgtagattggaaataggagtcttttgcatcctgtttgagcattccatgggttggtttccaacacaaatcccttgcttctcaccattataagattatttctgcaggaagattccattgacgtggtggctcaaggaggcaaacaggcttcaaaagaaaataggccgggtgtggtggctcacgcctgtaatctcagcactttggaaggccaaggtgggcagatcacaaggtcaggagtttgagaccagtctggctaacatggtgaaaccccgtctctaccgaaaatacaaaaattagctgggcgtggtggtgcacacctgtaattccagctactcaggaggctgaagcaggagaatcgtttgaacctgggaggcggagcttgcagtgagccaagatcgtgccactgcactccagcctgggtgacagagcgagactccatctcaaaaaaaaaaaaaaaagaaaatattcccccaaacttaagcagtgattctgtaacctaactcccatcatcaaaagagatgatgcctcatgtttttagagagtttttaagtgttctattttcatatacattttgtaagtatatgccgttgagaatgtgtatcccttttgtttatttatcattttctctctgatgctcctaaggcgggagaaaaaacttggaggaaaaaaagaaaatcaaccaaagaaccaagatttcaacaaggtggtcatcaaattctgtgtccagagtggtgccttcaaatgtttagatgctgtaatggctattttttgtctcataaacggggctattgtgccatttccacttactacgggaaatttgccaagagaaaagggtttcaaaactgaacagattttgaagccacatggcccattcaaatcattatggctaggatctgtcaaccatttaatgtgttgtaagcattatgttcagttctttaccttgggcatctcatacagtcctcttaattgctctagtaagcattatctgcagcacagagaagtcgagctctctgccacaggtctcatggctaataaatgatgaagctggggtttgatccaggtctggggctcccacacttgaccactatcctctgctgtctggcccaaaatttacaaactctaggaaatcaaaattaatatgaattgactttaatagtgcgtttatgatagcatttattgattgagtaccacctgtttgctaggcaatgtgctaagcacttcctcatatgcaaaacaagccacagccctctaaggactgaacagaaagaaatcagatgagaagaatctggtataagcataacagactaaatgagaaaccctaatttctttcctcttgaatttcatcccctgatacttttactaccattttgagcccacactcaatccttaaggctagcccatcttaaatattaatccaaggatgaaaacgccatttttgccacttaccgcaactaagacaagctgacattttcaaaaatgaatatagctaccatgtggaccaacctcaaaaacacactacaatgaaggaagccagacacagaaagtcacatattatacaattccatttgtattaaatatccagaatgagtaaatccatagagacagattagtggatgccagggctggagggaggaggaaatggggagtaactgcccagtgggtgctgggttgatggaaatgcttaggagccagacagaggtagtggttgcacaactctgagggcactaaatgccagtaagtttgtcacttcagaatggttaattttatgtgaatttcacctgaattgcttaagaagggaatataaaacctataaactgatacacaggtaacataagactagagaatcctgggcatcaagtccataaaactgacgtagtcagtaagttcattttgctaaggacagaggccaacttgtctcttttttctcaaactcccacacctcccaggatgctaccactcctttcagcctgtgacatgtgcctggcttacaactgaatattttatggatgtccttgagtgtgattaaacaatttcgcctgcccacacccaagttatcagctctatctcattcttaatccttctaggatgacacagaggtcttaaagaagaaattaccttttcagtttcacagttaatcaatggcagcagctgcacagtaagaatgctcgtatgcagtagtgtaaggcctataacctcttcccacccacgcttccaagggcttgctccctctccaccatcccccttggtaattgttgccacgctgagcctgtctgtctctcaggagaaactgggactaacagaaaaactgctaaagcaacagccacagagtaacaggaatctgcactccacaaaagtcttgcctgaatttgccctgccgtgtccctgctgtgtaaaaagaaaacctaggaaagactgagcccctggtcaatgtggcggtcaggtcctggcggtgagattgggaaatagctggccttgaacttctctgccaggggctcccttccagggccagctttgctatctctgcattttactaaagataccatttcctggtgcctggggtctagaggacccagtgggtcatgtgaatgaggaaggggctgagtgtgaagccacagatgccctgtgtgtggtgacagctgtgaggtgcctgcagagtggcaccagcctacaggctgcaggtggcagtctttggggaacatgagctcagagctgccacagcttccggttttgcaagacaatgcttccttctcaaactcccacacctccccggatgttaccactcctctcagcctgcggcacgtgcctggtttacaacaatattttatggatgtccttgggagctattaaagaatttggtctgcctaggcccaagatatcatgctgacaatctggaactttacctgaaatttcccaattgtaaaaggttggttcaaaacattatgaaatggccaggctccgtggctcacatctgtattcccagcactttgggaggcagaggagggtggatcacttgagcccaggagttcaagagcagcctgggcaatctagggagacccccatctctacaaacttcatgccttgctcttatgtggggaaaagagtgtaaagcctgtggagtgtttacaagtttacataagtaaactattgtacaagttacggatgtatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcgtgatccgcccgcctcggcctcccaaagtgctgggattacaggcgtgagccaccgcgcccggccgttacggaggtattttaatgctcctcacaactttccagattcttcaatttgcccataaaatctggtttctgagaaagacactggaagacactttcctagcagaatccagatcataacctagcattctctgcagctggtggtgctatggtctgtatagcaagaggccacccagcacagtagttatgcccatggactctggaagtggacagcaccacccttactggctgtcccagtgacctggggtcacttctctgtgctttgctcttctcatctctaacatagagatactaaaagaacctgctgccttggactgctgtggaggattaaatgcattcagatatgaaagtacttggaacagtgccttgcacacagcaagcattagctttatattcatccagaccatccctttatattcatcaaaagccaacaagtgaggcctccagcccggggccaagagcctattgatgacaccaacctcttgcctctggggacgcaggccgtagctgggccaaacctagacccacccttgccccacatgagttacaggtggagaggtactcaaagagtaaagaagagagacgcccatgctcccggtctactgagaacttcctcttcctctcgctagattaactatgaagtcaggaagctggtgaatgtctacagaaacacaaagtagaaaacagatctggtcccattccttcctaaaacattgaatgccaacccatcataagagctcagatatgtcctaagggccaagttatgtttgaacctcagcatagcaatgttatcaaaaaagcccgctgggtctccacctctccatatcagtattctgtcttaagctgaagtatcagtgactacttactgagcacccactacaatcagagcactgttttaacggctaggaattgtaaagaaaacaatggtacctggttctacagaagctcattcattctccaagttaacaaatatttattaaattctcactttgtgccaggcactaaggaaacagcagtgaacacagcagattaaagccctgccttctggtgcacataatgttgggagatagagatagataataaacaaatagctaggtaaattaaatagtatgtcagttgataataagcaatatggagaaaataccatagagagggagtgcctgaatggaggtgagtaattcacaacagccaggatgctgactgcagactcagtgagcctgcctcagcgccaccatggtgggtggggaagggaataagggaggcttcagcagaggctggggtagtccatcaggccaaggagcaaatgggaaaaaccaaagagactcagggattcgcagcccatgagagccatggggaagatgtcaagtgctcctgatagcatcacctgagtccaagaaagaagctacctcttcactagccacaggcccatgcgcccaaggctagcagagccactggtgaccaggcaggaagggaacatggaactggagtctagcaaatgccagcccctgacaccccaggagccggcgtgaagcttcataaggacctctccctctagctttaagccactgacccctctccccgtacacctgggccaccttgaggaaaggcatgatgtctgagagaagggaacactgcccagaggggctgcttaactgatccgcctggatcatgccttacctaggctagagcattcatttctcttgttgagagcacaggggaaaatcaaatcaactataaatgaagaaattacattttctctgcctagggggaggagacagggaggaagaaaaagtggaaactgtgagtacagaaactattttgaggagttttgcatgaaaatgatccaggagagaaaaactgatgacaagagagagagaaagagaattgacgcagtgatgtctggaggaggagaaaggagcacttaaggggcagagctgacttcagctgcaagtaccaccaactgtcccaggggagcacgagcagaggtgggggtgtggtagttatcttcagagaaacagggtgcaaggaaacctcccaaaggaaggggtggtgggtgttgggtctaaggagagaggagggggtataaaccagcagcctggtggtgggagagtgaatgaggtcaggtgagagttgggaaggccgggggaacgaagcaccccgctagaggttgtgctttcaagtgaaacaacgccatgtgagagcaggcaaggagtaggcagggaattcggcttcaccagggttgtggtgctcttggtggatggacgaggctgacaatggagaaaagagcaagggagtcgagggcgtctgtgtgggagtgatggcgactgcccgtggaatttacgttgggtaaaggaagaaagtgaagacctggggcaggcaagggaccgggaaaaggaaggaggagccagcgatggaggtcgcagtgggttgaaggattaccggaactgaggtgctaggggaagagagctaaaaagagagcgggcggaggtcagaaagagggctgactgaagtggaggtggaggaaggctggcaggcaaccgtgaggtgtaagttccgtcgacaggcgcggctgagatcgggtggagagcaaggtcataggtggaaaggaggtcaacaaactagaggccaaggcattccaagactcggcatgggtgtgaacggccgcagatgcagtgcttcaaagagagcgcaggcacctgtccctcagggactacgggtgaccacggaggaaagcgctagggagggcggttttaggaccgctggaaacagcagcgatgagggaggcgacaggtgtccctcctccaagctcacagtctgcatgtgagagagaactgcaggagaagcttgccctaggcaaagccaggtgtcaggtccagaatcgagactccagagaagaggttgaggatttaagccactgagggggtggagctgggcagtgagtaggacgtcaggcttgcaagctctgggattaggccgaccagagcccatatcccagtcccgcctcttactgcctgcttgatctcaagcaagaccgctttgttcatgggcgaaaggagcgccccgggccatgaggattaaatggagagcacagggccagatccatctaaattctcagtaagtgttagctattgttattaagaccacaccgaacagactgaacatccgttttagcccctttccccaattttcgttctttccggtgttgacaaatcctctagttttttaagtttataaaacatgttgtacataagaatgacatatcacatgtgaaagtactctagtgtccacgtaaatatttgtcttgttctttataataagtaaacatgctcacggatccttgaaattatctggtcactgccgggcgcggtggctcacgcctgtaatcccagcactttgggaggtcgaggcgggtggaccacctggggtcaggagttcgagaccaggctggccaacatggcgaaaccctgactacacaaaaaacacaaaatttagccggggcttgggcgctcctgtgctcccagctactcaggaggctgaggtgggaggactgcttgagcctgggaggtcgaggctgcagtgagctgtgatcgcgccacttaaactccagcctggacgacagtgagaccctgtctcaagaagaaaaaaagaaagaaagaaagaaaaaaagaaaaaaaagaaattatttggtcaattatatggtcagctccctccaccactcgcgaatttacagaagaggagaactgggctgggcgagaccaggactagcccaagattacacaagttactcggttgtagagccaggattagacaggagaggctctagattctggtctagactcccctcctattatttagcattatggcttcctgaggattaccatgagccctcctccaccgtcaagcggcagctaccagccaccagaccagatcccttcgaaggtgcccggagtaccagactgacaaaagcgcccgtacagtgctcagtcctgtaaccaaagctgtctagggtgcagacatcgctcaccggaccgggtagggctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgcgtaagtggagccgccgtggttccaaagacgcctgcctgcagtccgccccgccggggaccgcgcaaacgctgggtccccttcccctgctcgcccagctctgggcgccgcttccagctccctttcctatttcgattccagcctccacccgccggtacttcccatcccccgagaaaaccatgtcctgtcccccaggagctctgggggaccccagggcgctttgagggtgggatccccggatccgattcagtaaccagcagtgcttttccagagcctctgagaccagaaaggagagttggtaattcttaatccaaccacctgttagatgccacagatgaggagtcctcacagtgctcttgagaagacgagggagatttcattaagctaaaattttttatttaatgttaagtgatgctgaaggctaaagtaaaccttgctcgtatcaaaaagtaaagattgtgcagacctgttgtagaattcttttcaacagagaacagaaaacttgtctccgaagtgggtttgtggaaggaagcctgccaaggcggcttgttcagagaaattgctccttctggtttatgtccagccttgataacacatatgggagcctactatgcagttttaaagcaagtatccatgcagcctgcagcctggtcattttttctggggtgaggatctgcctaggtagaagttttctctaatttattttgctgttacttgttattgcagatggttccttgtcggggtggggggtttatttgcttcccaatgcttttgttaatcccggtgctgtgtcttatgttgcagtggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataaccagcacggccaagccaggctcctcttgcagttctaagactttggggaaaacaggtgtgtagagaaataaagactgcaaatgaggaacagatcctgttaagaagaatggaaagagggttgcagttgtgccagttggttaagaaatagaccgcatgatttatttaaccaaggtatgaaatgtaactgcgccaacctttctagtttccttcccacgtacctcctaaggaaggtcgattttaccatcatgaaatcccacatctcaaagtgtgctcttgtgtgatggtttcatgaagtcctcattctcctactcttcggaaagatgattgttcattttacagttaaatgatacacaaagatgctgccccaaaactgccacctctgagatcatgagtgtattttatgttttggatgtaaatgtaacagtacatctacaaggaaccaggataatgatagttttgatccaagaaatgatttaatacctatgtatggctgcaaaaacttttagaagtaaaaggaattctgggtagactccagtgttcaggggtcccacctctctccagatcacagcaaatcataaagtttaggcaaaataatagcctctttcagaagtattaagcaattgtgttgcaacccacttctccttgacactgcccatgggaccttcccagtgccactggccatggggtggcaaactttgggcatcaacatttgagagtagagagctcagcaggacatggctttctccagtgactacaaatgacgtttgtaaagagctatttaatatgctttatctcacctcagcttggtggggtgagtactgttgtcaacattcctgttttggaagtgagtcttggattgcccaaacaggagctggtgagctggagtctgaatccagtgtttaagttgctcacccaatcccaagccaagatgctgtccttactgaaaaacgccagccaatggatttagtcaagagtgaaagagaactcactggacattctgatcaacaactctgtaactttgttttgttttttagagtttaaaacacaaatatttttagagggttactgctgtcactcagctccaaagggcttcacttatgccaccttctgtatgaatggcacccccaagatgtgggcagggtacagctttcacagttgtacatgggaccttttttggggctttcagattgataaattcaaacctaaattacaataggatcttgatttgtatgaggaatttgtcctgagaccttcatgaatcttcacatctacaaataccagaaaaatgacaaatgctataacttcagagttataaagacagatagacataaagtcacattgagacttggaggctagagaggcagctccgttgattcactgacttgatgtctctgcttcacagcccacagtttgggtggctttggtaaatgtctaaattactttccgccacaggccaccatagtctcttttgaatagttaaaactacaaaagatgaatacataaataacaagggtctgcccgacatgcattcaaagttctgttgctttctcattttcttagccaaagccctagctcagtccccagcccggtccacaattggcacaggaatgaagtctctcgtttgctttttctcctagctagtggaagaagcagattgcagtcacttcaggaagcattccctaaactgtgttctgcagatttccagggattattggaaaaaatggttctggggttaaatatggcaggaaaataccacattgtgttccccctaccacaccctaaacatttcacacacataacacaatatagcatgtcagaggctctgagaagttgtctcaaccaacatttccttgacttattttatcacagaaccaactctccatcttccctcccaagaacacttagtaaaatctcatggagtgagaaatactttggggagcactgatgtaggggttctgacagtggaggtgtcagcctggagcctccataactctctgcttggtagcactgagtacagcagctgccacagtccttctgctcatgggagctcctctctggagcagtcaggagtggccacctccctagggaaagtcacagcaaagaaccttattaagatgtatataatattttattttatttttttagagacaggatctcaccctgttgcccaggctggagtgcagtggcacaatcatagctcactgtaaccttaaattcctggattcaaaccatcctcccacctcagcctccccagtaggcaggactacaggcacacaccaccatgcctggctaattttttagttttttgtaaagttggggtcttgctgtgttgcccaggctggtctcaaactcctggcctcaagcaatcctcctgcctcagcttcccaaagtgctgggattacaggcatgagccaccacacctggctcatgtataatattctaaatgtagaagcaaagacctctcttttgagctttctcgttcagaatctagaaaacaaggatttacatgacactttcctgggacttaagcatgtttccaggtgtgggcatagggaggattatccttcccttcccagatggtacctgagatggagggcctgaaggccatcccttccttcaggattcttgtgtggtctcagcctactagtggactgtgaaatcagtaagtgtgtcatatttttctttaatggaacagtgtggacaagaatagagtccattgtgtatcacatgtactaaggtaactattgtgctgtgaaacttttgtttcaattatgttttggttggtgtctttcccggttcacaaaataaaatacattctaactgtgggtcatggtggaaaatgtttaaaaagttgttctaagatctaaagtttttctctgttcttacactgacaactggctatgaaaagggaggccaagtcagcgaatcactggagcaggagaatcactgagctctggtttccagtccagggctccctacccacccaacccagggtggtaatcatggaggctatgggccagccactccctccaccccaacagagacccgtgctggcattccagccacttctctttgagccccctctcccttctgcaggcagaaccacttttgttaggtgagctgccaaccttggaagagagtttgtatttcattcattcccatggcaaatatttaccaagcaactgctaagtgccagacgtgtataatacaatacactagaaaaactagtccatgtgatgatgtaaaaatcaatcaactttctaatggcattctctgtttgaaatgtgtattgtgtcatctagactaacatggattcaccatttagatcagatggaagtgcagaacatcaggtttgcactatctgtctggatgttcctcctcttttgtatgtgagacatttccacttctgaaggaaatgttcaaagagctattgcacaacatccactgggatccaagagttccctgtgccaggttctcaaagagacacaggcaacgtgctaatggtgttgaaaattcaaacacgccctctcctgaccctttctactcatgtcataatgacatttgccagtatatggaagcaaattttagtggttgcacaggtctagtgtgttttgttttgttttagagacagggtcttcctctgtcacccaggctggagtgcagtggcttgatcacagctcactttagcctcaacttgctgggctcaagcaatcctcccacctcagcctctcaagtagctaggactataggcacacatcatcttcacacctagctaattaaaaaaaaattttttttaagagatagggttttattatgttgcccaggctggtctccaagtcctggcctcaatcgatcctcacacctcagcctcccagggtactgggattataggcataagccaccacgcccagcttaggtttagtgttttaaaagtggctttacttaaacatagatgggatgcaatatttaattatgagcccaatttctaaggattccaaaccctattacagagcccctagtcttctacgaggagcctttgaattcagcgtttcctcttctgagcgcacagggcacaggctccaaaggaatgctctgtggaagtcactcaacctgtccctggtgtacactatgtctctggtgtacactacagaggaggggactcgaccggcccccttaggaaaacactacacactttttaaatagtgcacacctgtgtactaagggttaaaaggctttttattccccacactaattctctgggtcagtggttctcaaacttcagcctgcatcagaatcacctggaggacgtggtaagacacagattgctgggcttcccccagagggttttggagttagtaggtctggggtggggcccaagaatctgtatttctattgaattcccaggtattgctggtttatgtcccaggtgaaacacagcgggatggcataagatttcatcacactactcagggcacgctcgactgaaaacctaacaactgtttaattctgaaattttccatttaatagttttggaccatggttgaccacaggtaactgaaacctcagaaagcgaaactatggataagggggactactttgtggttccaaagaagccatccagctggaaaagttctgttgttgcattttccacaggctcctgcaaataggtcctgatggtcaaatactctttttttttttttttttttttttgatatagggtctcactctgtcacccatgctggagtgcagtggcacaatcacggctcactgcagcctcagcctcccggactcagatgatcctctcacctcagcctcctgagtagctgggactacaggtgcacaccaccacacccagataattttttaatttttttgtagagacaaggtttcaccatgttgctcagactattctcaaactcctaagctcaagcaatctgccctccttggcctcccaaaatgttgggattataggcgtgagccaccatgcctcagcacttaaatacttttaagaaatgttgcaatactatataaactctttttggccatacagctttttttttcctctcatatattaacattccccaaaatactccaccttgaaattctagagagaagtttgggtatgaagtcagggctcaccataaagatttgggaggcaacagcatggaaatgatcatcttatccagtgcctcaaaaacttttgcttgcatcagaaacactagagggcttcttaaaacacggatttctgggcccactccagaagttctgattctgtaagtctgagaatttgcatttctgtgtagtttgcaggtggtgctgctgctgcaactccaggatcacactttgagaaccactgatttaagtgatagaaatagatggccccgactaggagaaagcttaccaagatcaaagcagaggtgcagggatgcactctaatgatccccacgctggctggaagtcaccaaagcaggcagaagagcagaaaagaaaaagcatgtgatgcatgtgatacaacccaaaggaagagcgtttcacagagggtcggaggtcaaggggtcacgcaccacagggaacacaaagagaatgaagtagggttgccagacgaaattcagagcctgaaactaaatttgaatttctgataaacaacatatattttatgtataagtttaaatattattagcatgacacactaagggccaggcgtggtggcaaacaccgggagtcccagcacttttggaggccgaggcaggagggttacttgagaccaataattcaacaccagcctggcaatatagcaagatctcatttccacaaaaaaatgcatttcttcattagctgggcatggtggcgtgcccctgttgtcctagttacttgaaaggctgaggtgggaggatagcttgagctcaggagtttgagactgcagtgagctctgatcacgctaccgcactttaaaaatatagcatacctattacttacattttaaaatcatttattatttatctgaaatccacatttaaatgggcactctatttttatttttaaatctggtaaccctaggatactggcaatggaaagaccacagagtctggcaaaaggaaggaatctagaaagtgcctttcaagagagtgctggggcaggagccggaagatggtaagttgaaaggaaatggccactgagcaacagtgggttagatggtcccagccttggggccctctttgtgcagggagctcagcagctgattaagcaactttgccgctagtcctgtactgtactgacttgtacccccacccaagagccagcctctcctgctgtggcttgtatcccagcaccccagttaggaaagcacctaccgcccttgtgttaggcatctgcactgcacagtcagtaattattttgatttttttaaatcacaaaactgaagaatgtgtctgattcagaacttcctggaatataatgtgtcatgacaatctgtcaaactgaagaagcttcgtttgtatctaacctgttcctaggtgtttatgtacacttaggcatttttttaaggcttaattttctctttctgcaaaaggggttgaatgaaataaaattttgttaaatgaataattaatttacaatgaggggtggttcttttcttcttttttgagacagggtctcactctgtctcccaggctggagagcagtggcgtgatcagagctcacttgcagcctccacctcccaggctcatgcaatcctcccacctcagcctcccaagtagcttggactataggcacacaccaccacacccagctaatttttgaattttttgtagagactgagtctcaccatgttgcccaagctggtcttgaactcctgggctcaagtaatccgcctgcctcagcctcccaaagtgctgggattctaggcatgagccactgctccaagctgggtggttcttcttctaaaaaaaatgtaactctgtgtgatgactgagaccataaaggataatgaagtaatatttaaatctgtgtaaagcaactagcattgtgccgggtagtaatagatttgataaatactacttaaatgtaaatggaggatagcaacattttggacagggaaaaatatcgatttcttaaaaactaagttcattgcagtattataatacattataatggagtgtttagttatataactattgcaatgtacgtataacatataataatacaaggtacttggtatgccatctggaatgcagtaattctcagtaaatgtgagctagcatttttgtcctcagttcatatcctattaactatcacttgttgggtctttttgtttgtttttaaaaacatgaaacaaaagtactgaacatttattttctaaaaatccaacaactcataagaggcatattcacttcattacttagctttttaagggacaccattggcattttactcccaaaggatgctatctttcactgaaagtcttcagttattttttgtatttataataaccccattcatatgattctgagttatcctccagcatgcatctttaaaaactggattcttgtgcctaatgcaagcatctggctttcttaaataaagatgaaaatggccaggtgcaatggattgagccttatagtccgagctacgcaagaggctgaggtggggactactctcttaagcccaggggttgaaacctgcagtgagctatgatcgagccaccgcactccagcctaggcaacagagcaagacctcacctctaaaaataaataaaaataaaaatgcatttcataaacacatttcccagtagcagttcctaagttggattctttaaatgttcctttactaatttccatatacattttgatttccttcgacaaggaaaaaatacaaagtatattttatgtttaagttgttgggctatatataaaaatgaataggcctgtaatcccagcactttgggaggcagaggtgggtggatcacttgaggtcaggagtttgagaacagcctggccaacatggtaaaaccctgtctctactaaaaatacaaaaaaaaaaaaaaaaccaactagctggacgtggtggcacatccctgtaatctcagctactcgggaggctgaggcatgagaatcacttgaacacaggaggtagaggttgcagtgagccgggattgtgccattgcactccagcctgggcaacagagtgagactgtctcaaaataataataataataataggaccaggacccttaacctcaagattctgtgacttgtcaggatgggggaaaaaaagtatgtaaataagtatagatgtgattaaataagttttaataaagagcaggggaatttagagaaactgtaccaagcattaaatgtattacttttagtaaccagaaattccttccatggatgtagttaagattttatagtatttgggaggccaaggcaggaggaccatttgaagccaggagttcaagaccagcctgggcaacatagcaagaccctgtctctacaaaaaaaactaaaaagttagccaggtgtgggagtgcacacctgtagtcccaagctgctagagaggctgaggcaggagaatcacttgagcccaggagttcaaggctgcagtgagttatgcttgcaccactgcactctagcctgggtgacagagtgagaccctgtctcaaaaaataataataataaaataaaagatgttatagtgattgttggctcaaaccatgcaaactctgctgaacatagtttattaacaataactctccatctgaggagtcattaaatctttctgagctcagtttgctcacatgtaaagtaagaaggttagaaccaaattatttgtcatctcttctacataaattattctgtgaatccctcacttccctcagccttgtaggtttgggtatattttagaaatttgctagaattaggccaggtacagtagctctcacctgtaatcccaacactttgggaagccaaaacaggaggatcgcttaagcccaggagttcaagaccagcctaggcaacatgacgaaatctcatctctacaaaaactacaaaaacatccaggtgtggcggtgcatgtctgtagtcccagctactcgggaggctgaggtgggaggatcacttgagcccaggaggtcaaggctgcagtgagctgtgattgtaccactgcactccagcctgggtaagagagcaagaccctgcctcaaaaaaaaaaaaaaaaaaaaagtactagaattaaacaaaagagacttgttgcacctaaaatagctttttataaagctttcaagtccatgaggttgattttcatttaaaatacagttgctaacaagttgggtcatctgctgtgcccaccaatagcatgttaaaagcattcaataggatggcacaagagaggaagggctattagcaacagaacagtgatgttgggagatggggtaactagactgacaggaaagaatgaggaaaagtgggacatccaatggtgaggtccatcacactgatcctgagcccccgacggcaacaccaaactatgctcagcactttttaaagaaattatttaaactgacaaataaaaattgtatatgtttattgtatgcaacatgatgttttgatagatatatgttgtatacattgtggaatggctaaatcaagctaattagcatatctgatacctcacatacttttttggtaagaatatttaaaatctactgtcttcgcaatttttagatatacaatttatttttgttaaccatagtcaccatgatgtacaatagatttgctttcttttcttttcttgtttgacacagggtcttgttctgtcgcccaggatggagtgcagtggcatgatcatggctcaatgcagcctcgacttcaggggctcaagtgatcctgctgcctcagcctcctgagtaactgtgactacaggtgtgcgccaccatacctgactaatttttaaattttttttgtagagatagcgtatcactttgttgcccattctggccccaagcaatcctcctgtctcgacctcacaaaatgctgggattacaggcatgtggcaccacactcagccatgattgcttgaatttattccctctgactaactgaaattttgaatcctttgaccaacacctccccaatctctccctgcttccgtttcctggtaactgttttactctctgctttttatgagttcaatttttttagattccacatatgagtgagattatgtggtatttgcctttctgtgcctggcttatttcccataacataatgtccttcaagttcatctgtgttgttgcaaatggcaggatttccttctgttttaaggctgaatagtattccaatgtatgcatatatgtatgtatgtatgtataaaccacattttcctatacactcatccattgatgggcacctaggttgattccatatcttggctattgacttgttcatttttaagaatcagtctttctgcccacaatgtgtggtgtcttccgtacacacatggtgggggctgatcagggagtagtggtgtggtcaggtatatttgtgtccaccaggtttccttccaaaatgaatgtccaggctactgggcttttagagaaatagtcccaaggtatctacgcactctgctgttcttggaaagtcaggatttgtcgtaagcacatctgtcgcattggaagcatctgaagaaaactgttctttttcttaacggtcattgcaactgcttttaggattccacagtgttaaatctgccctttctttagagcagtcaagaaagatgtaataactgaaggaaatgggccttcctccactgataggcatgatgcttttgaaatttaagtggagctcttgcatttgttttttgtatggacggtataaggaatggcacaaacgctagatggaatagctttatagctgttgagcatttgtgctcttttgtgcatcaatagatttctatttcattggtttcatttgttcttaaaaatgccctatttttattttatttatttatttttttgagatggagtctcgctctgtcaccaggctagagtgcattggcacgatctcggctcactgcaacctctgcctcctgggttcaagcaattctcctgcttcagcctcctgagtagctgggactacaggcacctgccaccaagcctggctaatttttgtatttttagtagagattgggtttcaccatgttggctaggatggtctcaatctcttgacctcatgatccacccgcctcaaaaaatgccctatcttaacaagagcctttggggggaaaattccagtggcaaacttctggcatcttcttgacaggcagcagcttaactacagttatcacattcacaaatgaagtggtaaaaaatattgaattttattatactttttggtttgaggaagccactaatgtggccactaaacatgatgttcaaatgaaaccttctgggaagtttttcagggattaccaggataacctagaatctcaactagcctttgacattattagaaacagtgtcccaatggtagagcacattattcagaaacttagattttctcagatcagcacctcaaagtacttatactaagacacaggacatctccagctcaacatgtcagagtaacacactgctgacatgtacagagtgactcaccaatctagacgcacttctatggagctccattgctggaagatcaagtggaaatacacacggaaaggcaaagaacttctatctgttcacaatttatgatgctcgctatctgcctgacatctatgtctctttcttaatgtttacatatcatttcaggtcctgtgttcccaggatggagactgagagtgagcacagatggatgtaagcatcacaaaatatgcccaaaaaaacactgaccagaggtcaggtcatgtcacttggttaacataactcttaatacaaaacatggtttgcatttaatgatagacacataaagcaaactctatacaaatgagtcagagcctccaaaagtaactcggaaattactgacaatacctgagataatattttaagatgctttgtttttcactattaggaagtaaaactatgatttgcattaggccacttagtcactaaaggtaaatttggctacaggcctcccaccaaatccattagccatctatgtcctacatgttgaataatcacagcctgaacttgcatgctttgaaaacttctctgtctccaagaagatggtattcaaagtgtcaagtttcatttctgtgcgatgcccgccagtggcgtgatgaagggattaaagtcattttgggaattacatttataatctaccaatctaatgaccaggatttgagttatcagcttttggaagaaataaatgttgaggaagtgagggagggagaaaaaaatttatacaaaagaacgaagcttccaactcaaatacattgtgttttaagtgcactattaaaactattccataaggaatagtttaggaagttaccagaaagtgatagaaactgtgtgctcacctgaacaggatttcagggtaaactttgtcttcatcaaagaatggacagtagccaggtccagtggctcaggctgtaatccagcactttgagaggtggagttgggaagatcccttgaggcccggagttacagaccagcctggtcaatatagtgggaccccatctcttaaaaaaaaaataaagaaagagaaaggaaggaggggaggggagtggaggggaggggaggggaggcgaaagggaagggggaagtgtggagggatggagggggaagggggagggagggaggaaggaagaaaggaaggagttacagttacagtttgaatggagggatgcctcactgttgccccacatgtgttgctggggcttgcacccctttgttgtatctctaccctaactgggccatcagctttttagcggaccacacatgaaccctctgttttacaagcaagacagaacatgagttcacagacactgacaactgatttgtctctctttggttattctttggttttttttcattgcctcatcttgatttatatgcataagcatcttgatttatttttgcaaaaaaaaacttccaaaaataaaagttttgtagtttacctaggaataatacacaaaatattgcatttttgtgaggaaaagctatttgtatagtttatttcaatctaataatatttgaaatttgtttgaaaagcaaaataaaaagaagcactgcagagtaactgtgtgattgcctgatgggttgtcctgcctgctacacagacaaaaccaattcactgggaacacggtactatagtaaagaataagtttaattaactaaggccagccaagtggaagaactggagttattactaaaatcagttttgctgagaactcagaagccagagtttttatggataatttggtgggcagggggctagggaatggatgctgctgcttggttggggatgaaatcataggggtgtggaaaacagtcttcatgcattgagtcggcctctgggtgtgcgccacaggaccagctgagttatgcatcatgggtccgggtaggatcagttggttaccagaatgcaaaagtctgaaaaatacatcaaaagatcaatcttagattctacaatagtgatgttatctataggagcaatgactcctgggcagtaagagagtatgaaaactatgcccatatttagcagaattcaggccgtcccataatcctaacctcgtggcctttcattagacttacaaaggcagttttagttcctggacaaggagagggtcattttagggagagactactgctttcaagttaaactataaactaaattcttcccatggttagcttggcctatgaccaggaatgagtgaggacagccagcctgtgaacctagaagcaagacggggtcagccatgctagatttttctgactgtcataatctttgcaaaggcagtttcaactgtccagattatttaggtcactcaggtgaaatgtatatgatgcacatgtaaactaacaacattcagcttttgtcatatgagtgactatgtaaatgtgaataaattacattttagctgttgataagacatatgtgcattattgcataagtatgcaaatactaactccctcttcttcctcaaggcactttgaactaaagagtcctcaaatctgaacattctttttattaaaataaatttgtgctccaaaaagcatataaagcaatttataaaagcatctaaaataaaacacacatgaagtaaatggggaaagtagaaactaacaaaaaattaggataggcaaaataagattataccaggaggaaaatgaggacataaaattcatatcctggtgtatggttaagaagtttacgtgattcatgggagacaggagaatcgatccttcaagtattccaagatgacatcttaaaagctagaaaactatgtcctcaacaacaatctttaaggcaagcatagtaatgaatgtcctagagctttttcttataaagccaatgagaaaaattgtcccacatttggaaaatgattaaatagtgactacttaaatttttttgctatgcatttttttttttttttgagatagagtcttgctctgtcacccaggctagagtgcagtgacacaatctcggctcactgcaacctccacttcctaggttcaagcaattctcctgcctcagtctcccaagtagctgtgattacaagtgtatgataccaccacaccggctaattttagtatttagtagagatagggttttgccatgttagccaggctggtctcaaactcctgacttcgtgatccacctgccttggcttcccaaagtggtgggattacaggcgtgagccattgtgcccagtcacattttctagtattagaaaataacatgactgcttgaataaaagcaggacattgttaaagggaactctcatttgatattcggggggaatgcaagtttgttgtcacattttttaaattaatagcacacaattcatagaagcatagccctctaaaaagagattaccttgctgaaactgaaaaagtgttaggattttatagcctttttaaataagtaaattaaccccaaacaagataccactatatacctattacaatggccaaattccagaacactgacaataacaaatgcaggtgaggaagtggagcaaccagagctctcatttgtcaatgaaaagagtcaaattctaaaaaaatctttgaagagatttactttgagctaaatatgagagaccaatgacccgtgacacagccctcaggagatcctgagaacatgtgtccaaggtggtcagggtacaagttggttttatacaatttagggagatataagacatcaattaatacatgtaagatgtatactggttaggtctggaaaggcaggaaaaccggaagtggggacttccaggtcatagttggattcacaggttttctgactggcaattgtttgaaagagttattatctaaagacctggaatcaatagaaaggaatgtctgggttaagataggcagttgtagagaccaaagttttatcatgcaggcgaagcctccaggtagcaggcttcagagagaatagattgtaaaggtttcttatcagacttaaagactctattctatcagtaattccaaaatggaggagggcataatgaggcaggtccagctcctccttcccatcatggcctgaaagttgacctgaactagtttttcaggttaactttggaatgcccttggtcgagaggaggggtccaatcagatggttggggggcttagaattttatttttggtttatacattcatttctgttagaaaggaaaaaaaggtacagttactttggaagatagtttggcagtttcttacaaaactaaacatactcttaccatatgatctaacaaacatactccttggtatttacccaaaggagttgaaaatatgtccacagaaaaacctgcacatgggtgtttgcagaagcttcttttttttttttttttaattttatcattgtccaaacttggaagcaaccaagatgttgttcggtaagtgaatagataaataactatgctacaaccaagcaatggaatattatttggcactaaaaataaatgagctatcaagcccgaaaagatatggaggaaacttaaataatgcatattgctaagagagaagccagtctgaaaagactactgttctgcaatgggcaggtctatggaaatctacccctaaagtctgcggaagctaagaggccaagaaagaggctgacacatttggtttctcaggaaaaaacaaacaaacaaacaaacaaaaacatttaatagggacttaggaagagaagccacaatgtcctgggcagctgccagacaaggtgttggattcccacactatgacccccacagacccagggcttccatgtcatagggaaggaatgtgtaggacaattatagggaaaggcaagatgctatgtgaatctgcctagagcagaatttatggtcaagggagttttgacctaagggcaggatttacagtaagtacaagctcttacacaaggaacagtagataaaatggaagatagcagccttccctaaattgaggttaatcaagaagtcaacagggcggattggcatccaagatggagttgcgttagcctccacaactacatacaatgattccaactatatgacattctagaaaaggcaaaactatggagacagtaaaaaagaagactagtgttgccaggagttagggtgcagggatgaataaagcaaagcacggaggatttttaaggcagtgaaactactctgtatgatatactacaatggtggacacatgtccctacacatttgcccaaacccagagaatgtacaacaccaagagtgaattccaatgtaaactgtggactttgggtgatgatgacatgtcagtgtaggttcatcaactgtaacaaatgcaccactctggtgggggatgttaatagttggggaggctgtgcatgtgtgtggcaggggccatatgggaaatctctattttccaccccattttgctgtgaacctaaaactgctctaaaaaaataaaatcttttttaaaaagttaacccaaaagtatatggttttattgccctaaagaaagttaaccaggcatattgtacctaacttagctattttagagaatccttttctcttcaagtatttaaatcctgttcctcaaatacactctgaactaggtctcattgctgccaccaacggttcactcattttaggagttaaatgagggggagttaattgagttttattggaaaacggccacactcagtcgttttcatatcatctatggctgcttttgtagcagaatggaatagttgtgacacagactaaatggtctgaaaaacctaaaatatttgctatctgggcctttccaaaaaagtttgtaaactccgggccaaataaaactttgacacttgctcgaatctggtatgaaaattttgcttgtagcatcagttaacatcagcagatgatatgataccaaaaagtacttggtatcatcagttaacatcagcagatgatacgataccaaaaagtacttggtatcagttgcttttggtaaaagcaattctacagagggccaaaatactttagctaaaaaccactgattcagaatctctaaggctgggacccagaaatctgggttttaacatagtctctgagggactcttatgcatactccagttggagaatcgctggagcccactggcctagcccagtggtggatgtacagattctgactcagaaagtctgaagtgcagcccaagattctgcttttctcacaagctcccacatgatggcgatgttgctggtctgagggccttagtttcctcacctgcgtaatggagatgataaaaatctatttcatagggttgttgtgggtagtaaatgaagtcataatgtccatttatatcctgcccccacccctttcaagctatgtctattggggcaagttaccgaatgtcttggttcctataagtggagctaaataatattgcccacatcacaaggttgctggaaggagcaaatgagataataaacataaagtacctagaacagagcctggaacactgtaaaggctcaataatgtaagatactattattactattatcattatcgttacatagggtgtctgatcatagcagatattccatcagtgttagtttcctccctactccctctcctatccatcctctcatccctacccctccctctagtgtcttctgttgatttcttttttatttttgtttagagatgctgtctcactctgttgcccaggctggcatacagtggtgcaatcatagctcactgcagcctcaaactcttgggctcaagcgatcctctcaccttagcctctggagtggctgtggctacaggtgcacattaccacaactggctaattttaaaaagtgttttgtagagatggagtctcgctatgttgcccaggctggtcttgaactcctggcctcaagtgattctctggctttggcctcccaaagggatgggactatgggcacaagccactgcacccagccctccttctgttgatttctaatgtgtctaattagataacttctataggaatgctgattcagaaatacctgaacccaggtggccctacctgacagtccagaggtgccacacaaacagggacccaaaatgagcttggacattgactgtgctgcccaggcccctctgcccaccccctctcaggcaggcttttggtagagagtttgggagaacaagggaaagtgggcttgccagtccttcccacctcaggggagcaccatttccagggctgcctgaacattcttactctgcagcacattaatctacgtggcaccaagtttatttttctgagaagattatttgggacaatatatggaaaatctgagaagtcatttctctttggcagcactgccctccataacaaagcacatattcctgaagggcatctggattttgtttcaggtttctttttgcttcctcagggtttaagtgctgccaggaatggccttctaagaattgcttagcaaaccttaatctccagactcagggtggtggggataatcacattttttgcccgaaatgaccaaattgaaaccatccccacagggttgacaagaatggcatgctgggttctggacagaaatatagttataattaagaatgaatcagccgggcgcggtggctcacgcctgtaatcctagcactttgggaggccaaggccggcagagtgcctgagctcaggagttcgagaccagcctaggcaacacggtgaaaccccatctctgctaaaatacaaaagaaattagctgggcatggcagcatgtgcctgtagtcccagctactcgggaggctgaggcaggagaaatgcttgaacctgggaggcagaggttgcagtgagccgagatcgtgccactgcactccagcctggggcgacagagcaagactccgtatctacaaaaaaaaaaagaactaatcagacaggcacggtagctcacacgtctaatcccagcactttgggaggccaaggtgggtggatcgcttgagttcaggagttcgagaccagcctggccaacacggtaaaacctggtctctactaaaaatacaaaaattagccaggcttggtggcatgtgtctgtaatccttgctattcaggaggcagaggcatgagaatcacttgaacctaggaggcagaggttgcattgagccagtattgtgccactacactccagcctacctgggcaacagaatgagactctgtcttaaaaaaaaaaaaaaaaagaactaatcaggccacaattcagcacacttccttgttgccaaaagtcactagatcctgaccatttgcatccccattgttcctaaagataggatttctgacattaagattataatgatggagacaggaggcagagaaattctaggcagacaggggcaggtccctggcaaagtcccatcctcaagccaaaaagcctgagactgcagcccaaagtgagaacttacatccctgttctcccgctcaaatgttgccttttccaaaaccacccatggcccgccctgccccctatcctgtgcttataaaaaccccagactcagccggcaaaaaggagaagcagctggacatcagagactatggctcaacgtctgagagaagtggcttgacttcagagagacagcttgacagcataacttcagagaagaatctggccagagacagccggacttcaggggaagattaccttcccaccccatccccttttcagctccccttcctgctgagggccacttttatcagcgataaaatcctgtttttaccatctttcaattccttcgtccaaactcatttctcctggatgccaaacaagagcctaggagccacaagtgcagatgcaaaaggctgtcacactggccctttgccctcactggtggaagacagctccctcacatgaaaaggcagagggaggctctgcagagctgctaacacttaagctgtctgcaaatggcagagctaaaagaccactgtaacactccctctggggcttcaggggttgcaggaaccccaccagatactgccttgggggcatgcatggagtttgctcctgctggtgctcaaaagtgctcacctggctcctgcacctgctcacctgtgtgctccctcccataaggggtggagagcagtgagtccgaatgagtggagttcactcctgctggtgacgaagtggccagctgattccagtggttgtgtactccagttcctgccttatttgctcatgcgctccctcccgcaaggagttgagagctgtgggctgagtaaatggggcacccctattgcgagtcctgcaaagcggtcagggaaatatcctacttcaataagactgtttaaaaatggatttgcatccctgttgttcctatagagatgatctctgacggaatcataaggcttttgtttaaggattgcttaagatgttctcagatccaaatttcagcgaccagtttggagaccctcacagaagaacgggatgagcataagaacacagcttcttcatctccctgtcccatgacttcaccctgtgctcttcgaccagtgaacactctccacacttgggcccactccaaaaccctaaagactgtagccccaaactcctcagacagatggatttaagattccctcccatctcctcctttggtgaccctataggtaaatgctttatctgctaaaacccagtgtctctggcactggtcatggagtgccttctcacaagagcaaaattgagtgtaaggtacattttcttccacaagccaggtattccataagcaccaccagcatcagcagatccagctacagattcagtgactatgatcaactccacagaccatcagcttgctttgttgagaggattctgtcctaataaacacactgctaagactaacattcccaatccacaggacctagaataaaagaaaattcaggctacttagagaataggtaaatgaaagatgaaaaagggagggacaatcaacagtattgagcacctgtgctttgccaagcaccatactacttgggatcatgtagcccttcatgaaaatttgtgataaatgttttaccatcatcctttccttccttctttccctgggctattccttcctcccttccttcttccctgagtaagtcagtcaaaaaggcatttgataacctcccctcccctccccttcaagggagaagaggctattacagcagaggaagaggaaggggctggaaagccaaagaagcaactagcatgctaggaaggtgagtcacatacaggggaactgagggtggaaaaaagaaagaaaggacagaggctgctcctttagcctggatcccagagccaattcacaggagcagcagcatgtaacatgagtaaaaattaacctttgtgggggcaagccactgagatttcatggtcatttgtgtgaaaggaaaatgaatcttggggccccaaaatcactaagctaaagggaaaagtcaagctgggaactgcttaggacaaacctgactcccttctattcaagtcatccctctgctcactgagataaatgtatatctgattgcctcctttagaaagggtaatcagaagctcaaaagaatgctagcatttgtttcttatctacctaagacctggaagccccctcccaacttcgagatgtcccacctttccagaccaaaccaatgttcatcttacatatgttgatggatgtttcatatctccctaaaatgtacaaaaccaagctgtgctctgaccaccttgggcacatgtcgtcaagacctcctgaggctgtcacaggcgcatatccttaactttggcaaaataaactttctaaattaactgagacccgtcttagattttgggggttcacatttgttacccacagcaagccgggtctaagccaactgatacagtaactggtaaataacttctgttcttagagtgtgaatacagcttgtctctctcatatcaaagcccatggtccttccacttgatatatagaattgtttattgatttaaaaaccattttattgattaaactggcctttgtagaactcagctgctctgagcttgtccacttctcagcacttagggaaaatttcattttataatcctttttagtcctcttattcctctgcagcagaacaattattccaccaatactgtggaaaagttagcctagtctgaaaaatatttcagctacaaatacctaaaaatgcaggataaaatatggctgagctagcaagaaagtaagagaaatagtccaagtatttaaactgctctgaaatactaaaggactgaaaatggaatgagaccaggagtccaaagagaggttaatgagcaataaagctaatgattgtttgaagggcagggcagatctagactgctggggattaaagatacacacacaaacacacatataacatatataggtgtgtatgtatatatatatacatatagttattttgagagtttaagacttaaagaaagttgcaaaaataatacagagttcctgtgttacccttcacccagcttctgcaataataatgtcttacctattcacagcactttggtaaaagcaggaaactgatactggtaaaatactgttaatacaggtatagatcttatttgtgttttactagttttgaatgtaccactttgcatttttggtgtatagctctatgaattttatcacatgtatagatatgagtaactgtcaacacaaagaaactctgtcgtgttacctcttaacagtcagacccttgtcccaaccataacatttggcaatcatggatttgttcttcaatgctataatttttctttggctatgagaatggtatctagatggaatcatacagtatacaacactttaagactggcttttaaaaactcaccacaatgcccttgagattcattcaagttgtacgtatcaatagctcattactttttatggctgagtagtgtcccatggcatggatatactccagtttgctttctattcattcactaaggactgtttggcttgtttacagtttttttgtttttttgtttttgagatggagtctcactctgtcgcccaggctggagtgcagtggtgcaatcttggctcactgcaacctctgcctcccgggttcaagtgattctcctgcctaagcctcctgagtaggtgggactacaggtacatgccaccacgcctggctaattttttgtatttttagtagagacggggtttcgccatgttgcccaggctgatctcaaactcctgacctcatgatccgcccgccttggcctcccaaagtgctgggattacaggtgtgagccaccatgcctggcctgttttcagtttttgactattaaaaataaagccaccatgacattcatgtacagagttttgtttgaacataagttttggtttgtctaggataaatacccaggagtgtgattgctgggtgatatgataagcatatgtgcaactttataagaaactgtcaaactgttttctagagtggttatgccattttatagtcctaccagcaatgtttgagagatccggttgctctgcatcctcactagcatttagtgctgtcagtacttgttattttagccatttaaataggtgtgtagtagaatctcattgtggttttaatatacatttccctaatggccaatgacactgaacactgttttacatgtttatttgccatctgtatatcttctttggtgaaatgactattcaagtctttgatccattttctaactggactgtttacttactctgagtttatatggttctttatatattctggatatgagtcctttgttggatacatgctttgcaaatattttctcctagtccatggcctgtctttaaaccttagtgttaattgccatgaaggcactgtcaacaaagtctacacttcaggaaaggtgcagaatggagttctctggatatagtcaaatcacctgaagagctttaccctcagaacaggcgaactagaaaaaattctacaagccaaagaaataaatagcaagctgaaagatagatctgaagaaattagccagaatgtggctcagagaaacaaaatgatgcaatattttaaaaataataatttagaacctcagaaggtttaacctatgcctaataggaattccaggaggagagtctagagtaatgttgtccaatacagtagtagccaatagccacatgtcactacttaaaatgtaaattaattaaaactaaatgaagttaaaaatgcagttccttggttgtactggccacatttcagatgctcaatagccacatgtggctggtggctaccatattggacagtgcagatatagaatactacaggaaatcctactggacagtgctgatctaggtcataaaacaagtctgaacaaatttcaaagaactggtatgatacagatgttttgtggaaataaactagacattagaaattaaaaacaaaataactcctactgcctcctctcacctttttccccattacaattccacctcttaatgtcttcatgttcttgatgagaagcagaacgtccctactgtgttccatggcaccaagttccccagaacccgccagtctctgatgacagaacatcctggaccgcccagctccacaccccaacccaagaagttctctaaaacactgaccatgacagcctggggtaggtttccactttaacattctgaccaaaattctcaactcgatgcagtcagagtctgcgcaacctgggacctcgagccaagaaatcctcaagtgaccttacttggcaaaaccaacaaaacaaccaaatacaggtctcaagcgatttacagctcggtgcttaactcggtcaccggccgaggggcagccctctggcgccaaagccccgcctctctatgacgtcacacgaggagccctgaagtggcggtcaagcttgaggcgtcatctggctgcgcctagtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtgagtgtccgggaccctgctcccgccaccctacctttcgctctgccctgtgcgtctcccgtcattgaactccagattccttgtctgagcctctttgcctcccctgctgcttttggatgtctcctgcccgccctctgcgtgtcccctccgcggtcgccaggaccaatcggctcggtcgcactggcttttgaagtctcgctttttacccctgttagctacttctcacaggacctagagctggggcctctgaggtcaaagagcctgaacatttccaaacggcgcttttgccttgatttccaaattaaccgcacgtgacgctttcctgtatttcgactgctttaccgtcgaaggtcagcgcatttttcgggttgtgttctaatcgctttccttttagcaacgccccatcacagtccaaagaaaagcttgcaccacgacgacgtcagatgcgaagacttttcacagcttgctttgggttgtccccctcagctatgtgtattagctgtaccgttttttcctgcagggtgagggctggagaaagaaggctcaactttttaagtggagaaggaggtagccacgactaaggctgaagcgtctactgctaagatacctctgactctcttgtcccctatctttttctgtgcctcttgcgaaagcagctgggcttaggctgcagcacctaagtggcattgagattggctccctttttcaccattagtaacaaagtttaaagtgtttgtcgtctcttttgtaggtcagataccaaggctttctaaagtcaaccttttcactctgctcagcctctggatggagctctttccagcagaagcccagcggcaaaaatctcaggtataatttgtttcatagtttttccccttagaaaagcagtggtttaaaatctgagtttattgctccagtttctgtcatacctaaaaccaaacttaacaaggcttaagatttaaaaaatatctttattgattaacatgacactttataattcccagccgtaataagtcatcttccattctaaaaatactttctgagaataccatgtttatcgggtactaatggtattcatatgtcagttcggctaataagattattgtctataccacataatttcccccaattatatatactgttggtgttttatctaggtagtttactcctctgccacagaaatatataaattgcctggagatagagaccatgtcttattttacctagcatataccctttagagtctagcattatatgagtgctaattgattaatgttggatggaagtagtctctttttggatcttgaaagacaggatcaaaacagattagaaatgggctgtgtgcagtggctcacgcctgtaatcctagcactttgtgaggctgaggtgggtggatcacctgaggtcaggagttcaaaaccagcctgggcaacatagtgaaaccccatctctattaaacatacaaaaattagccaggagtggtggtatccgcctgtagtcccagttacgcgggaggctgaggcatgagaatcgcttgaacgaatcgttggaggttacagtgagctgagattgcaccactgcactccagcctgggtgacagagcaagactccatctcaaaaaaaaaatcagaaatgtatagtaagaataatcataaaagccaatatattggaattggaagtataaacatcctgcgtcttttctttctcctacccttggggcaacaaggggctaggttctcattttcctccatgcttggaatggcatgatgctaggttctcatcatttctgtttgataattttggaagcttagggtgttggcattaatttttatagggggccacggccattggaaaatagtattaggttaagttgagcatttaagactttttttaaaacagaggtaaaatgaggggggtggggcagaaaattacacatggcttctcaccactctaacaacattactgttaatattttggtgcttccaatcttaagcatgaggttttttatttttactcttacaaagttgtagttatattctgcatgtactcgctgaggtttccaacttgcccataattctgctgaaaggttgctttagattttccagagaaagactataaatccttaaattcccacagtactcttaggagaccacctactcttttcattttactgtggatgaggttttgtgcttggcactggagacacaaagcagaaaaaacatggtctttattttctaatgagtagaaacactaggcatttaaacaattaaaacagaattggtggagtgagtacatagtataagcagagatgttggcaagactgggagccaggctctatatggggaagtgaaggaaggattcacagagaaggtcgtatttgcactgagacatgaaggattagtggacttttgcccaagccaaggaactctacatggaaaagcttggagcaatgagagaatttgtggtcctcaggccagaaagtgaagttaggtagagggaagagactggaaaggagcttgacaatgtagacaggaatcatatcataaaaagcattgtatgccttgcaaaggagtttagattttatcttatcaatataggaattgcattgaggaattttaacaggatgtgaggatattcgcttctcataataaaatgatatctcttggtgtagtttcctcccccaattcctatgtgaagtgttttatagatagtaaaacattatttaaaatattatacatcgttattccatatttctcaccctcatccccccactctggctctacatgttattaacggctgagaaagctcttcatttccttcattaattttgaaattcctttattccttctacttgttaatagtttagtattattttatgaaagtagatttccaagctgttagggattttatgtagtgttgtgttttttttgttttgttttgttttgttttcagataaaatttattttgaagagccagattagaaacaaatatttagaggtttaagacttttaggccgggtgcagtggctcatgcctgtaatcccagcactttgggaggccgaggcaggcagatcacaaggtcaagagatcgagaccatcttggccaacatggtgaaaccccgtctctgccaaaaatacaaaaagtagctgggcgtggtggtgcgtgcctgtagtcccagctacttaggaggctgaggcaggagaaacacttgaacccaggaggcagagattgcattgagctgagatcacgccactgcactccagcctggcgacagaaaaaaaaagaaaaaaaaaagaaaaaaaaacgtataaaaactggacatattagagattgaatacaaattttgaaaaggcgttcttttttttgtaaatatccagatgtgatctcgttttagttctgtttttttatatacacaccacatcctgtgctgaaattaagttttttttttcaacaggcacaagttgtatttaattagtgagaaatgacatttatgtttctattaggaaggaattgattggccaactaattgttgaagtttatttgcaaataatacacaccctactgtttcctcatactatatagagaaagctgtggatctgagaaaactgagatgaagctttcagttagcattttgttaaaaaaaatactaccaaggaaatttcaaaactatattagcaacaaaattttatacaactttatatcatgtttaacaaaagatcaaggttatgactctcattttctcccaagccaacaactcttaagttttcctggcatctcattccttcatctggtgggcaccatggaagttttctaaatgaaaataaataagtcttttgtttcagatattttatttgggatcttatttagaaatctgactcatacgcatgtctatttaaggcttttaaatggaaagttataacacatagaaatgagtacagaaggcatcaaaacaaagaacatccatgtcttcagaaagccaggcaacctggaactaggattgacttggctatatgaaaggttatcactcttagctcctggtcctggagcatgcccagctcctattcactgcattggtgtctttccagctgtgctcccatacccatgtgtcctaggactacaaccctctcaccatggtcttgggtaggcctttacttctgttcttacctacagggcttgggactccaaggcacttggggagggagagcctcaggattactctggcagtgatctgggtgaaagaggcttttgcatgttaacttgggaacttgactatcatttttaacattgtttatatgagaaaaatgtgttttaaattccgaaaagggagatttaccaagtatttagaacatgattgtaggttgtcaattacttgtatatttaatgtcaataaagcagaagtatataatttcattagttcttctgatatcatggccattgcaaaaaagcaagaccaatgatagtgtgggggaagaatacagaatgaaagggagcatattgtactccacttttatagtgttatttattgtacaaacattatcattgaaactgaatttatagctgcaacatttttaaaaactatttttttctcttggatttcctttttgtactagttaatatccacataattttgcaggtagttgcagtcatagcaggaacacaattttgtatttgacagttttggtactgttacagggttgataagttattaattttaaattatacagtaagaatacatctaaatttcatatgcatgtagtatatgctgccattgtgtttatacttgtggaaatattaaatttctcaaaatgttgcccaattttgtgcctaatatttctttaccatttactatagtatattttttccagtattatttgcacatggtattcttagagttgagtacaaactttttccaattaagagaaaaaaagtcttctttaagctaaagtaataagattgtttcacttaaattctttagtctgcttttgttgtacagagtaaatcacagaaataccaagatgcaattagacatgtaattgtattggaaatactgcttttgatactttaccaacatttgtcttactaaaagtatttttatgagttaccaaagtaatatatgtttgttatttttaaaatggacagaagaaaaattttatcataattccacctcctagagactaattactttttaaaaattgtttctcagtcttttttctcttactttctttacttacatgagatcatttaactctggatcctacccttttcacttaacataagaaaatacttatgctgtaatgctagtataaacattggagcagcaccttagtctagtaatttagagtagccagtggttttacagccagcctgcctgggttcagactctggctccgcctcttactagttgtataactttgggtaactctacctctctgtgtcagcttcctcatctgtaaaatgaaatgttactagtatatactacatgaggcttttatgagaaatgaatgagttaatatttgtaaaggtcttagtgcctggcacatgttaggtactatgtgtttgttgttgttgttgttgtctccttatttatttatttgtttatgtatttattttaatagagatgtggtcttgccatgttgcccagactggtcgctaactcctgggctcaagcagtccacccgcctcagcctcccgaagtggtaggattacaggcatgagccaccgcacctagcctcctaactctttccattgtgtcttctggtaccttatgctaaaggccctcactgtacttttccagaacagaagcaatgtggcataatggttaagacaatggatcttgggctggatctggcatatccacttaattacctgtgtgaccatggttgaattatttaatctctctcagccacaatttcctcatttgtacaatgggaataataggagctactttataaagttataaggattaaatgagataatttagggcctggtacatgataaacatgcagtagatgttaggtactgttattatcatcactcatatatataattattaccactactagcacccacatccttaccgtttttccactgataccatcacttcctctacttcctgttctgtctgaacagaaacctcattcccagaacatgggttttcttataaacttctttttgatggttctttcttttctagcatccagcacttgtttcataagactagcaggtcaacatttacaaagtttcccattcctactttaaaactttatcaatgtattaactatcccacccttttttttttttttttgaaacagagtcttgctgtgttgcccaggctggagtgcagtggcgtgatctcggctcactgcaacctccatctcccgggttcaagcaattctcctgcctcagcctcccgagtagctgggactacaggtgcgcaccaccatgcccagctaatttttgtatttttagtagagacagggtttcactatgttggccaggctggtctcgaactcttgacctcgtgatctgtccgccttagcctcccaaagtgctgggattacaggtgtgagccactgcacctggctatctcacctattttggagctcacagaattctgtgtcactttctttgtcttaatcaacttacttcatagtcactttcctgttttcataaatcataagccctgtgagagctgcatcttgagcaactaggctgtcatgtagcaagggttcaataagtatttgttgaactaataaatgaaggactttggtccctgcctcaaaactttctttctacttcaagttttcactttttccctcatggatatacctgtattcgttttctattgctgctataacagatgaccacaaagttggtggcttaaaacaacacaaatttattatacagttctgtaggtaagaggtctgaaatgagccttactgggctaaaatcaaagtgttggcagagccaaattcccttcagacactctacgggaggacctttccttgccttttctacctgtggagattgtctgttttccttggctcatgggccccttccatcttcaaagccagcaatggccagtcaggtctttcatgttgcatcgctgactctcccacacccctcttttactcataatgacccttgtgataacatcgggccaatcagataatcaaggataatctccctatgtcaaggtaggtggttagtgcctcagttccagctgcaaactgattcctccttgccatgtaacaaaacatagtcacaggctccagtgactgggacaaggaaatctctggcggggcattatcctgcctaccacaatcccgatctaatacctttgctacatagttccttatcttctcaattccagttaatttacctctattccactttagtcattcatggccacactttggacttttccattactcaaaactgccacaattctgaaaccataaacttcagaattttattttctcattacaatttccaatccttctatgttttgggaaagtacataggggatagattataaaggtttatttactaggtaaagtagtatgaacttgatccaaacaaagtgggaagtcaatgtagagtttcatcatggaaaaaaaaatggtcaaagccaaggaagccagcctttaaatatgggaatattgaattagtcatatgtcttatgtgctaatctttttttttccttaatctgatttttattagaaaaatgaagagggaaagcatggacccttaggagataatgaagagaggaccagagtatctactgacaaaagacaggtaaatttttatgatttcacatatatatgctcataataacaaagcaaaaggaatagtataaagtagaataaaagtgcctccatttctactatcaagggagtttttaaaatactcttctaaaaatggtctgtatatttacaagactatatgtcactccttttttttaaaaaaaaaagtacagatgggattattctatgctacatcctacatcttgctttaaaaaaaaaaaaactcttgatggttcatatagatgtgttaagaaatactctcccttagttctctcacactcccacacaccttgctgggtatgccaagaatgcaaggccctaaccattttttacctgggtcatttctcagagttgtgtttgcagtgatcaaccctgaaggttgaggtaatatctccctccaggacaaaaagcaatctggcttactttctgctgtgaaacagtaggaccctcaagctcagtgttcctctcctataacactacccaccctgtgtccaggcagccatctgtgcccatttgtattacccctcatggggcttgagggcaggaaacagaaatgatgctcatactgactgctgtgctgcaaataataaagttcattgtttctaacccagaagtttcatgttttctgctaatatccatgaaacagtaacaggttaacttattagttggtaagtagggtaaaatcaaagtgcagacttgaaagatgaaccttgttctttttaatattgtatagtatttccttgttactttattcctttgagttttccagaggttccgattcattggatgcagagtggagactaagcatgtatgttttgaagagttaccttgatgattccgatgtatattcctagagatttcctaattcattctgagagtgagcccagtaggaatatagaaataatttgtctcagaatatttacatgttttcataataagaaaggccaagggaaaaaaaatagtgaatcaccatttaagtcaatgtactagtccatatacaaaacagactgtacccttttgcccatgttttagtgtaaaactctgtgactaggatcaaacagatgacttgccaaaatgttagcgaagtgaggcaaaatcaaattcagagcagcgattcactgaaaagattcagtcctctgggagttgtggtaaatggaagtgccaaaatggaatgcaacttgagcttttatttgttttattgagtttgggatggaaaaatctttgtctcaaacttggtattttggccttacctagatgcaaaatgaaaaaatacatattttctgaggtaaaaaggactctagacaaaaaagtgataaataaactcgacccaaaagattgttctaataacaaataagttgatgagtgtgcttctcacttgataggaacaatttttttttttatgttttattctggctttatttctgtctgtttaactaggaaaatctaaagctgaaatcattcccttgcagccacttccactggttacgttggttcaatttaacaataggagctctgtcaagatcttttgatgaggcagcattacttcttttccaagatgatacgtattggccgggcacggtggctcacgcctgtaatcccagcactttgggaggccgaggcgggcggatcacgagatccagagatcgagaccatcctggctaacatggtgaaaccccatctctactaaaaatgcaaaaaattagccgggcgtggtggcagctactcagctactccacgggctgaggcaggagaatggcatgaacccgggaggcggagcttgcagtgagccgagatagtgccactgcactccagcctgggcgacagagtgagactgtctcaaatcaatcaatcaatcaatcaatcagtccagcctgggcgacagagtgagactctgtctcaaataaataaataaacaaacttattgaaagtattcagaaatcaataataatatatgcttcgcatttgaggagcataaaactcaagaaattttggtagggaggggaaagtgttcacaaattcaaggtcaatttaaagcttattttaaaagccaatatagataggtttttcatattttatatacatccttaggtacatattttgtaaagcagagatttttgtattcctttataaatgtccttctagtttaggagatggttggttaactcagaaatggaattccataaaatcttctctgttccttcttttttagatagtttacaaattattctccgtaatctcaaacattcatactcaaaaccgaaactgaaacttgactagttaatatcgctttggtctgatccttaaagtgatttcagatatgctgtattgggggataagtatagggttaaatccctttggaaggggatggggaatagggacaccctctccttagcccaagctcccctcatgtaacagtcagtcccaagcccaaggatcaggtttacattccttacttcagaggcttttgctgtgaaaacagcatagactgttttgtgccttatgcagaactgacttttttttttaaccttagtctgttttatctgatattgttataccagctttgattagtatttgtttaagttgagaaactttaggttcaatagtaacacaaaaccttcactcaaagagatccactggaagtgcttagaaccccagtcagtaaccagtctgcagggcttaattcaggctcagccagtccctgctctgtggaatattgctaaggtagctcaagctcactactctgacatcaagttctctcatcctttttgacacttgatggtatgtcttccttctttttgtttttataacttacctatagtaggaggtgggacctaactatagtagtctagactgccatagtgctaaaaattgatacagccagtagtttctcaaaagaaattgagaattatcttttctttggtcaatatctaaaatattttagaatttaagatgacctctgctttagttctgccttttaccatctgtgggtctttcagaaagtcatgtaaactttctgggctttacttatccatgtgtaaaatcagggctttatattctttattaccatctagaagcttaatactaaatggtactacacttaatcctataagaaacaagtcaaattgatctagttcttgccctttactaggttataatgtatctaatctttcactagaacaaattaatgataattacatgcttaattgtttgattagtagagcctaggtttagaaaatttctggcctaaagtcaacactaaagtttcagaagctttttggatctaatgagaaatgtgctttgtacaaactctgtttagataaagaattaaacaaaacttccatttttattaataattcaagtataatccataatatgattattaggtgttataactaataagttgttattttatatcttaatgtaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatggtaagtgcagaaaagggtttgttggggattaagagtatttatctgggatgggcgtggtggtttatgcctgtcatcccagcactttgggaggacaaggcaggaggatcgcctgagcccaggagttcacaaatagcctgtgcaacatagggagacctcatcactacaaaaaataagttagctaggcatggtgatgcacgcctgtagtccccactacttgagataatgaggtgggaggattgcttgagcccaggatgtcaaggatacaatgacccgtgattgcgccactgcactctaagctgggtgacagaacaagaccttgtctccagaaaaaaaaaaacgaagaaaggagcgtttctctgagagcagtcagtgggaacacatttgctaaataccacagagataatttagaaatatatatctgaaagtcaggtgctatggcttgcacctgtaatcccagctactcagaaggctgaggcaggagaattgctcaagcccgggagttcaaggctgtagtgagctatgattgctccactgcactccagcctgagtgacagagcaagaccctgtctctaaaaaataaaataaaaaatatgtaaatatatatctgaagacagtttgatacattataagagtaagcatcagaaaacatggattctggtctcattcatgtctactaacctattaaatgaccctcagtgtatgagtagactaatgctaactgctataacaaaacaaaatttcagtgacttatgtactagatatttatcacctgtataatagtccagcacatgtgttgctaaacagcaggcagctttctccatttggttgattcctgggctaggcatcttctgtctcattgctgttgtcacctctagggctttgagtcctctgtatccagaggcagactgagaaagaatgagtagagagggtgaacctgcttcttaaaaaccctgacctggaagtcacatacatcatttctgttctcatccattgtgggaactgttgttcccactgggcagctgtctttcagtgactactatacactttggaaggaggaacacaaatttttaatgtatagccatccgtccacaccaggctattcactaaacctccttgtgcttatgattctgttttgcacccaggtatatgccgatcattctttcatttaaaaaatatgcatcttgttgcataggcatcatggtagatcaaaaaacaaaaaaaactaatgtggttcctaatctttactctcgaggtgttatttgggggccaaaataacaatttaatatgatgcattatctagtaccaaatcagcgatacaggttgtaagtgatatttggtctcagaggagaaatagtgatccctgcagatttccatattatgaaaggctggggcttaagcttgatcttgatgcgtcataggtagaggaagaggaacacattcctggtcagggggaacagtgtatatggagtcatcaagttgtaagaagcaaagttctaggggtcagtatttgaaatggagaattattcttggagaacagtggcagatgaattatagtgatagtggagaactttgaagaactgtagagcctttggactttatcttataaaacagagttcctaggcctgttgtgagaaagagctatttttatttacagcaaagccttaagagtaatgatcagatctatgtcaaggtcagtgccttgagctataaatggcagaacttctagaagaaatggatcatgtggctagaaacctctcggcctgcaacaagtatttcgagcaggtaggtatctgtggtagtgattggattctatattctcaactgcagttaccaatacattgagaagataggtatgaaagtggtggtggcatttttttcaccttttcccaattaaccaggcagattggacatgcatttcatcactcatgttcaactgacctacagttcctgtttgtaggtaatgtggagacattgaagattcttgagaaagatgtaacgtgattgaaatttttgttgttattgctgttattgaattggagcagggagagattagagattgggagcttgattagtagactattgcattaggcaaggtccaaatagggttcagatgatgacattgatacagaaatgaaagaatgtgaaagaaccaaaacatttgttggctgatctgttccagatcaagggagaaaaatgaataaaagatagttgtgctttgtgctgagctaactgtgctgaaagcagtcttaatagcctcggagccacaaattagagggaagaataggagagtgcaggtaactcatcactgcttgatgtcttaagacatttcatcctgacaaaaaagataatgaagtatggaaagtcaggaaggacctacagtggaaatgcttgtgtattggtgttggacaatatataaacaaaattgctatgttagattaggcttatgtattatatttagttatcttaggaagggggcatggttgaaccccatgctatagctagattactttagttagaattgctattacctcagttataaggcaaagattgttgtagcacagtggttctccaagtgtggtctgtggactcctgatggtccacgaggtcaatgttattttcataataatactaccttcaggttgggcatggtggctcatgcctctagtcccaacattttgtgaggctgaggcaagtggattgcttgagcccaggagtttgagaccagtcagggcaatatggagaaaccccatatctactaaaaatagaaaaattagctaggcgtggtggtgcatgcctgtagtcccagctactcgggaggctgaggtgggaggaccactggagcctaggatgcaaaggttgcggtgagctgtgatcgtgcctcaccaatgcactccagcctgggccacagagtgagaccctgtcccaaaaagcaaaaacaaaaacactacattcatactaatggtaccaaaacaatgataggtaaaactactgtttccgtatctttatttttattttatttttttttgagacagagtctcgctctgtcacccaggctggagtgcagtggcacaatttcagctcattgcaacccccgcctcccaggttcaagcgattcccctgcctcagcctcctgagtagctgggattacaagcgtgcaccagcatgcccggctaatttttgtatttttagtagagacaaggcttcaccatgttggtcaggctgatctcgaacttctgactcatgatctgcccacctcagcctccgaaagtgctgggattacaggcgtgaaccactgcacccagcctgtttccatatcattaagacagtggtgccaaactgccctggtagtcgtcatactcttcactgcactcagagggaaaaaagaaaaccagttttacataagaaggtccttgatgaaacagtaaaaagtatcaattttattaaatcccaacttgagtctgcatctttttaatattctgtgtgaggaaacaggaggtgggtataaagtgcttttgctacagacctaaggtatgaagatggctttaaggaaaaccatgtatgtgattgtttgagttgcagactgacttatctacttttttaatggaacatcatgaactgacaatggttagttagacttggatatttggcagatattttcttgaaaatatagtgaacctgtcactttcagataaacaactgacagtatttgttgccagtgataaaatttgagctatcaagtgaaaattagaattttggaaaactcatattctctattatgagcctgacagcatctcaccacttagactcttttgatgggattggtggtgatattaatgaacgggattttttttaatattgtaaaatcagtaaatcattgttttccggatgaccaatgcacaatgctacaaaatcatgcatgagtaaaagccattctaagtgcaagacagaccaacggactttaacgtaacagttcaaaaagtttgttgatatggtttcagattctacattgtaactaacctttaagaaactatcccttgtcaaatttttatgtagtgccaaagaagaatattcacaagtatctgaaatggctgttaaaatactcctttttcaaccacatatctatatgaggccagataattttcgtatacttcaatgaaaacaacatattgcaacagattgaaaacagaagcaaatttgagcatccagttgtcttctattaagccaaatttttttttttacaaagcaagttactttattagaattttaaacaatgtataagtgatggaatcattctaacaacacatctattcactgcttacaattccaaccaatttcagttctctgatatctaatgacaagagcgaagacctgttaaagttccttccaccagtaaaacccacagctcaaagttgtgggagtgattaactgagccataggccttcattcacatgtttaccacattaaaataccacacagtgttttcttataaggtcaaccacctgggaactaattaacattagcattaagatttaaataaactgttaggcacagggctagatcaggcattataaaaccctgtggttccctagtcaagtcacacaaatccccaaatattttagcttgtaacagttttgtccttcctctcttgagacaattatttgggtacttgcttttggcaataacgtaattcacaatggaagtttcctaactgtgatggtgctttaggcaacttcggagaatgaagatagaaattatgcatgattatataacatgaagagtttaatttctattacacactcaatttccatgccctgatttctcttaactctataaacacatgtaaatcttctgcagagctttaaagagctctgaaagggaaaacacctttccatatatggaattgatagcatagtacaggtcaggcgcagtggcccacacctgcaatcccaacattgtgaggccagtgggaggaccacctcaggtcaggagcccaagaccagcctgggcaacatagcgagaccccatctctaccaaaaaaaaaaaaaaaaaaagagctgggtgtggtggtgcacacctgcaatcacagccaatctggaggctgaggcaggaggattggtagagtatgggagttagaagttacagtgagctatgatgtcaccactgcactccagcttgggtgacagactggtctctatttaaaaaaaaaaaaaaaggtatagtgatacactattaattccatgtatgctaatatgagatagcatccatataaactactatcaagtctttatgtgccagctactgtaataagtcttttcaagtttaactcactgaattcataatgaattatgaggtagctaccattatttcccccattttacaaatagggaaactgaggctgggagacattatttaacttgcccaagtttctaaagccagttactggcagaactggtatttgaacctacttaatctgattctagagcctgtgctatataaactcttacccactatgctatgctattcattagtatccatttaacaattactactattgcaatagctgcaattatcactcctatagtacaggggaatctatcaaagaaacactcagctttcacttatctatttctgaaaacattttttattaaagtataaggtgcatttcactgatctatttttataattgtcaatttatttaagtactttgattatatgatgtaagaaaaatgttagaaatgtcttctggaattaaccagaacacaataaatgtgcaaaaattagaatggaatttacagagtttataggccactgaagcccatccatgaaacccttcatgaaactcattcatgaggccaaagggcagaacaaaccctccctgaaaatctcaattgggcttttagaatttaaatttaaatgtctatacgaattctgctgctcagttttgtccttccactcttcttaattttccagtgatattgctgataactattgtttttccttttactattaatccaaatattaaagatatttgtaaaaatttaaaacaatctcattcttacaaatttttgttttggaaaatagtttttttcataaagctaatgttatttatattaatgtataacagattattgttatttttaatgaattaataaatattttaaattttgttttaattttcaagtacagtaaatatcagtagatatattccacataaataaaagctttttggagtcctcaataatttttaagagtgttaaggaatcctgagatcaaaaaatttgagaaactctgctttagcatttgccactaatacacaaatgtctgtctaaagaggatttttcccctcttgaatcaggattactggaagcagctaagatgcctagatgaaaggtttaccatcactgctggttaggaaatggattatgagaactcgaacagagggaaggtgaaatgcaaccggaggaaacactctgatatgaggtttgaggccttcaaaattgctttgcagcataagccacagtgagtcaggagtaccagggagtggatagaatgtttatttgtttaactgagactttttagttcatcaattattttgaagggtagaacactctgtgggctctctttctatttgcttctgggtacaatcacaaaaaaaaaatctctcctagctgaaattacatgcagtactagcaaaggggtctctttgttataaactgttcattaattgacgaacatttgtgtacttaactatgtataaggcatctcatcgttcaatttcaaatacaaattaaaatattttttcacatttgttatcctgttatgttttctcttttacaaattgtctgttcgtatctttttgtctctctttaggccttattcttgtcaattcatatgtgctctaatgaattgaaatattttctgtatattaaacattactaacctttcctctgtcacactgattgaaaaatgatctatttagtttgttgttttgtctttaattttgtaagctttaaaaagttaatattgcccttcagacaccatcccaacatcacataagaattttttcatgttataaattctttgtggacatatttgataactgttttattatgaggaggaccataattaattcaaccattcccctattttggtcatttaggtttttgggtttgggttttttgtttgtttaacgtctttgcttgctattttaaagaatgctgcactaaatgtgcatgcatgagatttcttctctgtatttagaatattttcctagaatggattctcagaagaattctcagtctgtggagaggaacatttttaatgcatggaagaggtatttattccagatagaaaactaggcaatattagttgttccctgtaagattttaaaaaacagccatggcaccatggaggactcttcgagtatatagttttagcgctgggctttgggatcacacttcacaacaccagtaactccacaaatgcattcctagaggctctgtgagaggctgggtaactttttcttgaaaaggccagataataaatattttagactttgcaggccgtgtggtgtctgtcacagctactcaactctgccacacgaaagcacccaaagactatataagtgaatgggtgtgtctgtgtttcaataaaggtttatttatggatactgaaatttgaatttctgacagttcgatgtgtcacaaaatgttcttttgatttgtccaactattttaaaatgtaaaacccattcttaacctgtgagctgtacaaagactggcagtggactggatttggcctgtgggtggtagtttgccaaccctcaggctatataataggtgacttggtaatagacatttattatattgagggttctagatatactgcaatgatagggtggattttataatgaaaaccctaaattcagcatgtatctcataattacctttcgtattttgtatttcagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactggtgagttacatagatcgtaaattggggctgattggttgggttgtatttgtctctgaagtgttcgtctcatttatggtagagttcatttactcatagttacttaagttttgctgttcatacaatatagagaagttagtgagacccttgagtagacaactctttctcccagcagttttgggattccttgtagccttatattcagtaccacatttctacatcaggccctcattaatctaggcccttctttctgcttcttgcttttatgatttcactgttccttgagccctccactaaaggtaggacaagaagagaaaggagaggcccagtgcagtggttcatgcctgtaattgcaacactttagaaggctgagacaggaggatcgcttgagctcaggagttcaagaccagcgtgggcaacatagcaagacctcgactctaacaaaaaaattagctgggcatggtggtgtctggtggtgcgtgcctatagtcccggctacttgggaggctaaagcaggaagattgcttgagcccagtagtttggggctgcagtgagctacaatagcaccactgtactccagctccagagacacagcaagactctatctccaaaaaaagaaaaaggagaaaaccaaaattattcatttttgttaactcttcaatattttgatgtactgaatatttaacaatttttaaaaaatctttacaataacattaattcaaaataactaatagaatcaaggtaaaggaatggtgattattgcagattcttccagttgctggtatgtcttcaatcagcaagttgagaaacatttttactgtattgtattaagttgtatatttggaaaaggaaaatattacttgggatttttctttgttatgataaaagatggcatctgtatttccaaacatggaacaatattatcacatcttacctgatgtaagatttctcaaagtagaatcatgatcactttttaaaatgcatctttgtgataaaggggaaaaaacatagacaggaggagcagtagagtaagatttgtttggggagtgtactgtagtaggatttaaaaattatcccaagaaagaagagaaagtcatcagaaaaggtctctacagatgctgctggtctgcagtagtcaacagaagggaggttctcagctggcagcaaatagaatcgccattgaaacttttataaaaagtacagatgctatactttttacttttataaaaagtacagatgctatactttttacttttataaaaagtacagatgctatactttttacttttataaaaagtacaaaccccaacccagacctattaaaccaagtccctaacaaaatatggccaagttctatgtttttaaaagttccacaaggtgttctgatgttcgcagagttaataattgctcaattcttcttaaagattttgattctgtaggcacacattatatgaccccaaacaattgcattgtgtaaaagtctggtttcatgtaattatattctattgtgggttatatatttgtttctttgccaactccagctttgtaaagaatttttctgtaaaccattcaaaaagatagaaaacataaatgggaacagctgttgtagctataattcactaattacccttcactaattagaattcagcagaaccctgcctgtgttccagagtaagagggcgatgtgaatctgctattttactggatcttagtacctcttgcttctcatagaacaccttatcataccagctgtgattccagtgtttaaagacgcagtatgtatacatttgcatttatattgtttattagatactctacactactgtatagttataagtatatccactattgtgcagaattttgtacataaagccctgcttacgcatttgatggtcaatttaaaagatttttcaaggttaattgttggtgattttttttttacatggaactcaaatcctgaatagggtgcaactcctctgtcactcactctactccactgtgcactcttccagggaagaaaccatgtcttaatcattttttccttagcactaaacacaatgtgcgttgaatggataaaacaaatctttttatccaaagataaagggtccacaatcccttatgcaaaacttttggagccaaatgtaaaggaattcagaatttttccgattttattttattttttttgagacagggttttactctgttgcccaggctgagtgcagtggcactcatggctcactgcagccctcaacctctcagcctcaagcaatcctcccacatcgacctcctgagtagcttgtactacaggtgaaccaccaccatgtccagccaatttttaattttttgtagatatgtctcactgtgttgcccaagctggtctcgaactccttggcttaagcaatcttcctgcctcagcctcccaaagtgctgggattacaggcatgagccatcatgcccaatccagattttaaaaaggtaatatggtacatatactgttatataggactcccagtggcatctgggacagtaccctgtaatcacattaatacatacagagtgaaaaaagtaggaatatttgcactaagaataattgagggctataaataactcaatttgggtcagatttggccgcaaaataagtgcatcaaacttcaaaaaaactggatgtaaaagatttcagatcagggactctggacctgtaattcttccttaatgataaataataacaatgacagtttatggaacacctactatgtgtcaagcactgagcttggtgatttatatatgtatctcatttaacattgagggtacttcagtaaggtggatatccctatgatacagtgcgcttccaattaagcttttaatttcacattattcagtttggtttgatgacctcatttctccctaattaatagatgaagataccatttcatttaaaaatgtacatatgattaaaatgaattccaaaacctctaacaacagagttctaaaatgaattgaaagtagttgcttataattgctttttgaatgatgaataaagaggatccatagagatgtcatgaaaagtatgttactagccaggtgcggtggctcccgcctgtaataccagcactgggagactgaggcaggaggactgcttgaggccaggagttccaaaagtatgtttctagaatacccgaaggtagcaaaaaagtggaaaaaaaaagtgtttagactcttggggaaaaaagagcaggaggaaggcatcaaaaatcttatctatctgctttaagtactgagttgtgatctcttcgtgtcttgctttctcatcagattaggtgttttccaaagctaaggattatgccttcctcctgggccacagtactgataatgagagtaggctggagtaatcaagaaagttaacttttaaaacagaactcagtggttctcagatatgagtatgcctgagaatcaagggggagctcaggagtaatgcagattcctaagccttgcctgcctctctcagagaggttgatttaggggacttccatggaagccaggagttgcctctttttttttttttttaaattttaaaaacaagcatccagtaattttgatgcaagaggactgtggagcaccttggacactgacatgaccacaggattgggagctaaaataaccacacctgtgttctagaacaaaaagttcccctctgattttcagtgatcaaagagccccaggaatttgactcaatgattgtaagttgacctttccttcaaagttgtacagagaaaaccctgtgaatgaccagatcatagggagcaatttctgtaaaaattatagacatgaaaagatttttgagaaattacctcatctgtcaccagccttgatgctgagtgacatcaaatctgttttatatggatgaaaatttattcctattttaaaagacaagtagtaaagaatattctcttgatgtaaccaaccttagctaggcagcagagctgcatgctgatggaaaaatcacattttttttttcctcctaacaaggtttagtctgtccccaggctgaaacagaaaaagtggcttctgtgactaagaaacataacattaaaaatatgcagtgttgatggtagaaaagggggcttttaatatggagaatttttattctggttttttattttttcattttagatttatgcataaattaaataaaactttaaagattttggttttgcaggcaaatataatcttatgtttataacttctgccacttaccttagaaatgagcataaagccattgatttgtattcttgcccactcatgttaaactctaaaggtctaggaaggaacccaattttgtttacaccaaaatcccttttccctctactctgtagaaggaagtcatctcgtgcactctgctgttcagcctcatttatttccttcagagcacagcacataaagtactgtttgtttccttgttgctgttctccttcaccatccaactgtaagtcgtatgaggaagggactacagtttccctcaccactgcatcctcagttctcacagtacttggaacataagaggcattcaataaatggaaatttttgtcaaggatttctttttcttttttttttttttttttgagatggagttctgctctgtcccccaggctggagtgaagtggtacgatctcaactcactgcaacctccgcctcccaggtttaagcaattctcctgcctcagcctcccaggtagctgggattacaggcatgcaccaccacacctggctaatttttgtatttttagtagagacggggtttcaccatgttggccaggctgtgtcaaggaattctttatgtcacggtgcaaggtggaggaaaggccaagcaggttggatctggagggctaagttttagtctatttctttgcctgtttctgcatctagaaatggaaattttatctgctttacctttagggtaaaaatgagatcatgaataaacatgtttaacataaattatacaaatgctttgtggtataattttgaaaaccagggtttgcttgaatttgagatgggaaattttattagagtatcataactgttttaaagttaacctcttaataagacattcattctagtttttaatgcaattgtggcacaaattttctttgtacctttactggaaagtaggtatttaaaaatgttatcattggagggattcacttttaggaaattgtagggtgaaaccacggtttcagttaatcctccccaaaatgaaaatgccttagggtaagttcacagataattgttattttctacgtgtaaatgtgccacttaactaccttagtcccttattaagattttgataaatactatggttttcataattagtgtaatttgtcttagaaatttgaaactcaacattgtatagaaggaaaaagtaaatccttaatatgtagaatttctattttgttttttaattttctgtttcagattaatggttttaagaagtacagctttacttttgcaaaggttttggttctacagggaaattataatcttatgtttgtttataacttctgctatttgatttagaaatgggcaagatgtcattaacttgcattctttttccctcaaggtaaactgaaggtcaaagaaaggacaacattttgtttaaatcagaattctcttcatgtactttctagcaatagatagatagatccataaagatttgtttatgttcgtatgagaagtttgaacttttttcttagcaagaacattttcataagatatattttccatgattagagtataaataatgctgggaaaagacaaatttggttgttgtgaacagttattacacaaaatccattagttctgaaacctttattaaattttatcacctatcagaagtagttgtttagaaaccggcttgttaatggagaatcaatgaagttgcacttagttctggctacagctttgagggacctgactgtggacactgccatttagtggcctccacatacgtatgtgtgactgagttggtagtgactctctctagttatttggtacctagctcccatattccatacttaaaagtgtttattttaatacttttctgtaattagtgaagatacaaggattgctgctacatttatgaagtatgtttcaatacaagtttttattacttttggaaaaatatatttctaaaactaacatatcataatttttactgagttaaatgccatatatctttcagaggatcataaaacaggagttggggcagtcatttgggcagaagggaaatctgtaagtatgaaaacaattctttaaatatttaacctggattttgtttaaacatagttcagtcttcggtgcattacaggttactgactgccaaggcgggcagatcacaaggtcaggagattgagaccatcctggctaacacaatgaaaccccatctctactaaaaaaaaaaaaaatacaaaaattagctgggcgtggtggcgggtgcctgtagtcccagctactcgggaggctgagacaggagaatggtgtgaacccgggaggccgagcttgctgtgagcagagatcgtgccactgcactccagcctgggtgacagagcgagactccgtctcaaaaaaaaaaaaatattaatatttttgtaatggtgcatttatgaagatctataaagatttgctcatccctcaacagttttctagatagacgcattcattcagcaaacatttgttaaacactctctacaggttaggcactgtgccacagtgaatgctggggattaaagatcacattttatggcctcatagtttagtgatggagatgtagaagtaaaatataactgatatgtaagtgtaattataactgatatcatgagaacatagaggaggaacctttgcttggaaaaataagtaaatactgttggtgaatattattaatgttactaatataatattcttgaagaataagataatttcttcagacagagcaagtcaataggaccaggaggataacatgaatattcttggtgaacattcttttttttttttttttgagacagagtccccctctgtcacccaggctggagtgcagtggtgcaatcttggctcactgcaacctctgcctcctggattcaagtgattctcatgcctcagcctcttgaatagctgggactataggcatgtaccaccacacctggctcatttttgtatttttagtagagatgggattttgccatgttgaccaggctggtcttgaactcctggcctcaagcagtccaccctcttctgcctcccaaagtgctgggatcacaggtgtgagccaccatgcctgccctgaatattcttaatattaatattaataatgttaaaattcttgaagattaggaggatatcatcaggcagagcaagttaatgggaccaggagaataacacacagagactggggtgagagagagaatatgggaaaacgcatttgatttggcacatagagtaagcaacaaagtggacgggaccatgaagaactctatattccatgtaaagattttggactttatcctggcagtgacatactatagcacagcactaaccagtagagagaaaaggcaaggctcaaactgaattttaaattttctaggtgttatatatatatatatatatatatatatatatatatatagagagagagagagagagagagagagagagagagagagagagagagagagagagagagagagagagagagtctcactctgttgccaggctggagtgcagtggtgcagtctgagctcactgcaacctctgcctcctgggttcaagcaattctcctgtctcagcctccccagtagctgggactacaggtgtgtgccaccacacccagctaatttttgtgtttttagtagagatggggtttcaccatgttgtccagaatggtctcaatctcttgacttcgtgatccacctgccttggcctcccaaagtgctgggattacaggtgtgaaccactgcaaccagctggagccatgtttttaaaaggaagacagataaattaattttaagaaaatatttaatcatgtaatcaataaaaaattattgatgaaatattctgcatttaaaaaatattaaatcttcaaaattctatgtgtattttacacctgcagcacctctcaatctagactaaccacatgtggctagtggcgactgtatgggacagtgcattccaagaatgttctaagtggggaaatgatttgatcagatttgcattataaatagaatgaggtagggctagacagaaaataaggagattaataaaaagagatgaggacttggagatgtggggatgggttaggaggctagaatcaagagatatttagtaactatatagctgactgaaaggtgagcctacattttgcctcagggacttcacagaaagtaatctgacaatttgctttgatgtttcacaaactcctcaagttcactcatccagtatcttccctgctaacctcctccctcatcagtggtcaccatcttgtctgttactgtacacatacaatcacctagcacaatggattccaccttcaaaatacctcttgactctacttacctgtaccccaactgttaactcctactagaatactaggctcctctgccagaaattcctcagcactctgtacaacttgtctgtgacattcatcacagttaaagttatctgttcaatttcttaccctccccagactagaaggctcatgagggtagggactctctgtcttgtttacagttgtattccagcacctagcataggtctaactggtggttggaactctcatttgtgtgtacatgaatgctcagcagacttttggcttaacatctggttgttaatgattttgtggagaatgtcagtttctagttatctctagagtaggccagcaggcagcacggtgaaatggaaagacacatggcttagagtcaagtaatctgggcttgaattctggctatgttacttactcattttgtgaccctagacaattaatcactcttgtcctcagtttccttatctgtaaaacagtaatattaatagtatcactctttaggttgtttcaagaattgatcaaatgaaatgatccatgtaaaactcagtatggctgggtgcagtggctcatgcctgtaatccagcactttgggaggcgggggtgggaggattccttgagcccaggagtccaagacaatcctgggcatcatggtgagaccccgttgctacaaaaaaagaaaaaattagccaggcatagtgacatacgcctgtggtcccagctacttgggaggctgagatgggaggatgacttgagcccaggaagtcaaacctgggtgacagagtgagaccctgtctctaaataaataaataaataaataactcagcatgatgtttgacatttagtaaatgttcaaacagatttattaatgagataatattttgtttgcaggcttttgttggctcactattacatgatttttatgaagctgctacagtaatgagtctgttgatattatcatgagtaattataatatattgaaatttaatgagttttatagcatattccaaaaaactattacacacacattactaatatttcattctaataattgataaagcattcatattaactactatttctctttaaaagagaaataagagccattgaagtaagaagttctataataatatgcatataatagaggcttaataaatactgaagatgaaaatgcattttttattttccaactaaatcacaatagcacatttttagcccaacagaaattttctgtttaaagtatttaaaagtttttgacttgctaaccagtagcatggcacagagcacataagaaattaacaatcacttgttgagtacctgctatgtacagaatactcgaacatgttgaagggatggaaaagaaatatataacatggtttctgctctccaggatctataatttatttgggaagtaatatctgaatcaagtgaaataatttgttagttaagtaagatagtatttaattaattgcaaaaaacaaggacttccttgagattatagattagagaggtggttggccttcttggaatttagctttgacaagatcacactgcagtaggagtatctggtattatattttttgatagctcagtttactgtagaaaattgaatgaatattcattatacaaagtatgatagcaagcttcaaaaatacattgcaaagtgtcttttcagaatgttgaaactaaccattggtttgctcactctcgtagagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtatgaaatccttcttggtgtacttttctttaaaatgtagcaagggttggttgaaattaattttcttataattgtaatttatttcctttttcaaattccaagaaagtttcctttcagaagtataactttggtaaagcttggtcctcactgccagacctgaagctatgacctgacctgaggtcatcgcctcttcaggtcttcccaatttgttgagcatgtctttttttcccttgcctctctccaatatgaaactgctttaagtttatcctttgggatcttgctcagcctctcatatttctggatgttaaggctcctttgttttctaaatctggagcacgcatttattaatacagttacacgccacagaaagacattttgagcaacgatggactacatgcacaacgtgttcccataagattataacagagctgaaaaattcctgagtgaagtagccattgtaacatcacacgttaccttttttatgttcagatacgcaaatacttaccattgtgttacaatggcctgcagtattcagaatagggatttataatgaaccaaattgcttcaaaagagcttttgttagtgattatacctgttaatttacatcattttcacaaacacttctcagcctttaccattaaggttaagggattaaaaaactgtgtaagacatgactcctgtccttggagagcttctaatgcaataggggatatgagacggcatccacctcgtgctgtggattctgtgggaggggcaaatgtaaagtgctgcggacattctggagctgctatggacaaatgggagagtgcaagggaaaggctttagggaagaactggcatctgaactgagctttaaaggattcctagactggggcaattggaagggaagggaagaccattcttgcttctagcataagcaacggtctagaagtaggaaaatccgtggtgtgtttaggagcatgaatattccagttaggttggaatgtggacacaagggaaagacagctcacaaggacaggctgggactggactcgagaggactttgagtttatgctccatttggtaggcagcggggaaatggaatggcattgacagagccatacgctatagattatgtaggtagtattgtttgaacagactagatgcatagaattctgttgccctagtccaggtgaacgtaaataacagtctcaacaaggaagatggatgtggaaggctggcggtggaggaattgaagatggctggctgagagctacgtaagcctcagaacccggaagtcagtccttgcagccccagttgttagtcctaaactaccctcagcatgcaaaatttcacccaaaattccctctattcttttccttgtcctcttcattacagatttacttgcttcattttgtacagaggtgtgaatatatcaaatagaaacttttctttttaaaattatcctatgatagggaaggggtaagggaactataagtcaaaacagaacttaagtatttgattattcatttagtaaacatttattgactatccactaggtaccagatagggctgtgtcatttgtctaacaagatgagttagtgtctaatcagacatgattagctcttaaggtatcagtttcaaatctaattccagtattctaaacaggtacttatttagaaagcattgggggttttttctctctttctttggtgtctgtatcttcctgatttcatttattttgtaatctgaaactgaacctcttacttagaatcaataaattatttttagttataataattgtcatgttcaggttgtatcataacacttttgtgggtttacatactttgaacattcagtaattcagcaagtctaaggcttgatgatcattattaataatgtcataaatctgtttttaaaacagctcaattttagtgtttaaagatttttctaaaaaataacttaccctttcagaaacgacctttctgatattttataattttttttgtaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacggtaagtagatacacatttttttcaggtgtattttgtattatgttgttaggtaccctgctgcaatattgtaagttagtgattcccacccttttaaagagtttcaacaaattattattattattattattattattattttattattattatttgagacagagtctctctctgttgcctaggctggagtgccagtggctcgatctcggctcactgcagactccgcctcctgggttcaagtgattctcctgtctcagccccccgagtagctgggattacaggcgccggccaccacgcctggctaatttttgtatttttagtagagacggggtttcgccatgttgtccgggctggtctcaaactcctgagctcaggtgatccgcccgcctccgtctcccaaagtgctgggattacaggcgtaagccaccgcgcccggccgagtttcaacaaattattattattattgagtttatttatatgtgcaaacccttacctaactgcaactgttcagctaaggattcctgccttatgaatttacatctctgtagagaattgagccagtggatcttttggtgccatctggtggctgataaaagaaaaatctctgacccatctcttccctctcctttctggcttagagaggtggatagaggtgaaaatacttcagcagtccccacccttttcggcaccagtgaccggttttgtggaagacaatttttccacagatggggttatggttttgggatgaaactattccacctcagatcatcaggcaatagattctcataaggagcacgcagcctagatccctcaggtgtgcagttcacagtagggttctgctcctatgagaatctaattccaccgctcatctgacaggaggtggagctcaggcggtaatgctcgctcgcctgcactcacttgctgccgtgcggcccagttcctaacaggccacggaccagtactggttgctgccaaaggtttgggatcccctgcaatagtttaaaggtcacccccacccccaaacaaagggaggtgcacacacacaaacacacacatttctcatgagaaaaatcaggaaaacaagaatatttgtttatttatttatatatttattttgagatggagtttcactcattgcccaggctggagtgcaatggcgtgatctcggctcactgcaaactcagcctcccgggttccagcgattctcctgccttgctacccccacccccctccccccaccccccagtatctgggattacaggcgcacgccaccatgcccagctaatcttttgtatttttaataatagagacggggtttcaccatgttggccaggctgctcttgaactcctgacctcaggtgatacaccggcctcggccacccaaagtgctgggattataggcatgagccaccacgactggcccgggaaaaaaagaatttcttatttgatagttccaaaaatgtactgaggtagttcatggaaaacacaagaacttttaagtctttatacctcttcactatttgggttctggtttttgtgggtttttttttttttttttttgcttttgtttttgttttgagacagggtctcactatctcacccaggctggagtgcagtggcgccatcttggcaatctctgtctcctgggctcaagcgatctgcctgcctcagcctcccaaagtgctgggacaagcatgagccactgttctcagcctattttggttttcaaaaagctttttatttggaaaaaaccttaagcatacagaaaagttataaaaacactacaaagaaattttttcccagaagttgttgacatgataccagctcaccctttatttcctcaaatgagaaataaccacataattacaaccataaaaatcaggaaattaacattgatacattactgccactaatccacagattccagtcaaggttcattagctgcccaagaaatgtcttatatagcaggtttccccaacccctgggtaccagttaagaagcttcttctgtatttatggtcactccccattgctcacattactgcttaagctctgcctccggccagatcagcagcggcattagattctcatgtgagtgtgaaccctattgtgaactgcccatgcaagggatctaggttgtgcactccttatgagaatctaaagcctgatgatcccccattcctcaccatctggtctgtggaaaaacttccatgaaaccggtacctggtccctggtgccacaaaggttggggactgcttttatatagcaaaaggatcctgtccagaatcatacattgtttctatgacatccaatgatttaatcctggcattgaatgagttaatgtaacatttaactactagaatttgcagtgggaagaaaaatgatataaaagaaccgtttatatatttcagctttacattcctgccatatacatcagtttgagtccaggatacctggaacatacatatatatgattaacttggacatataacatataattatatatgtatataattttaaatatagaaacatactatccagtgtctgtcatgtgtatatgaagtatcataagtttttaccatttgtaatattgtcatttttttctaattgtcttatttaaagtttatcacatttttaaatgagggggtgttgacatggcactgaaagaaggcagagatgggaaagataccttttttgtaaaactcaataaaagcttatatccaactagtcagagaaatctctacttccgtgtttttgttttctgtctcttcattcctcctgaagagtgtgaataaataggtttttcaagttctcctcataaagattaagtgacttaatcataaagattaaggactatgagtgatgggttatggagaattctgaaatatcttgcttactggtagattttaatagcttttcaattgtaaagagaatgaagagatcagaagaacttaagaaagggcaagagaagcagaaggaggcaggaagactaaggggatcttcaggggcagagatgggaaaggaagcacccagttgggccagaccctcccggaaataccctcactcaggcacatgttccaaaggctgttgttcatggttgttctctgttctacctccagtgaagatgagctgtccatcttctcatccttctcatctggcctggctgcaaatattatgtagatggttagctagatacctagttttgtaaatgcaagtaattaacatgaactagaatttgttctaaatctgaatttcagtaccaagattatcaaaaatagtgtgtgtcaataaatttggtatttgtttttaagattaaagcaaattgaaattactttgaaagattttttgctttcctttttgataagttaccatagaccttgagataagtagttctattctgtggtgttgtcacaaaccaggctaggactgggcaacactgtttccaagaatagattttatcaatctatatccatgtccacatactcagttctttgttttctctttaatatgtgtggatttttctctattaggttatattacttatttttattatgaaagtagtatatgctcattgtagaagactaggaaaataaaaaagaacgtgtattatctcacaactcatagataccacaattaacatgttgctgtattttctgccactaaaagttctttaaaaaatattttaaataatttaacacaatattccaacccataggcctaacttatttaaccattcccatgttgttggacacctggattgtttctaagtttttacagttataagaagcctttttatgaatgtccttaaacataaattcaggattacttgtttttactttgtctgcccaaattaataggttttagtggtttgacgtctttcaaaaaatgcctaattttaaacatttttttggtaatttctcatgtagcttcctaccctttctaagtcttctctctttcttggtgctagcctaaaccatcccattcgtttaaataaccaaccatttctagatgtcctccctttccagggacttttaatacatggtaaaatgtttgtcctgtatctcatcccccctcaaggctcgtgatgttaactagttaatctgatgagtgaactgatgcttatggaagaggctcccgggtaatccatatttgtgtcctgagatggtgccctagcagggccttttggttaagtcattagtgattctgatagagattctatccagctgagaaaagaagggctgtgctataagataccgattactctccatttttattttctcctgccccaatattctatgtaatatctgtgaatcttcaggcttccctatttattcctgaatggttgagatgaaatacagtaatcagaggagatatatgatatgatataaaatgatatgatgcaggtaatagtttatgatataacaacattaaaaggcaaggtaatcttggtcatattttctttttcttttcttttttttttcttttttcttttttttttttgtgagacagagtcttgctctgtcttccaggctggagtgcagtggtgcaatctcggctcactgcaagctccacctcccgggttctcgccattctcctgcctcagcctctcgagtagctgggactacaggcaccggccaccacgcccagctaattttttgtatttttagtagagacggggtttcaccttgttagccaggatggtctctatctgacctcgtgatccacccacctcagcctcccaaagtgctgggattacaggcgtgagccactgtgcatggcctatcttggtcatattttcattctttaatacctaggccttttctagctattataagattctctaggacctggagatagaatacaatgcgatgttaattccatagtactgggcatgggttctaattctattgcctcctgtagttagggtgtaacctgagacaagtcactccaatcctctggtcttccacttacttccaattaaaatgaatgtaaagaatcttcaacttctctaagagtattgattcggatcccagaagttatatcattcaggatcactcagtgtggcgttattagggctttgttaatttgaacatgctaacttctttttcttctatttttttaattttttttttttttcaagatggaggcttgctctgtcacccaggctgaagtgcagtggcaccatctcagctcactgcaacctccacctcccaggttcaagcaattctcttacctcagcctcccaagtagctaggactacaggcgcgtgccaccacgcccagctaatttttgtatttttattaaagacggagtttcaccatgttggccaggttggtctcaaactccttaactcaggtaatccacctaccttggcctcccaaagtgctgggattacaggtgtgacccactatgcccagccatttttcttccatttttaagaagttgttttgatatttaaaatcaatgtgctggaatgctatgtattaaatcctctttaaacaagtaaaatgtttgtgcactcttacagtggcagctgaatccatcaggagcttatggtcttgaacaaaatgagcctgaaaggagagaaagtaagtatttatgtattgaggtgaactttgttgctgaggagaaaggatatacagtgaattttaatgatcaggtgatgaaaattgtgttaatagatggagcatattatttttgaaggttagatttttgccattcaatttgttcataaatatttgtgggtctaccatatgctaggtgctatggaaagtgccgattaataattactcctatagaatctacaggttaatacaaataattatgcacaaattgactttataaattaaatgcatatgaaacagtaaacagcaatgctcttctataacaaaacaaaagcttattggggagtgagaaaggaaaaatatgtataattagtacagatggattgggaccaaatgatgaggatatatacattcttctagagtaaacccacatttgcccagattggaaatgttctggtaacttgaataatctgattaactaagaatcatcacagctaccataatgaattactagtctttaaagctttattattcgtatactactacagatattttgaatgtaatataatctttgagaagtcttacaattctttaggcacataattttagatatgagtgctatataatattattctaaaatagtaactataggccaggtgtggtcactcacgcctataatcccagcactttgggaggccaaggcagggggatcacttgaaatcaggagttcgagatcagcttggccaacatggtgaaacctcgtctccactaaaaatacaaaaaatagccaggtatcatggcacatgcctgtaatcccagctacttgggagtttgaggcaggagaatcacttgaatccaggaggtggagtttgcagtgagccgagatagcgccactgcactccagcctgggcgacagggcaaaactctgtctctaaaaataaaaataaaacagtaactatattatcgaattatttggatttgaagtaaatggaagttttctgtaagttttcttgataataacaattttttaaccttgaaaaatcaagaagtataaaggtcttagaataatttttctgtgaatatattgattttcagtgttctgaattagctttatttgattcaaatagaaaatgtattgtttgcaatttggaaaaaagtacatatccactgcatctttctttttaaaaatttattagcaaaaaaggctgtatctatctatctatctatctatctatctatctatctatctatcggtctgtctctctgtctatctatacatctgattaaataatgtacactcaatgacagtgtttgaaggggccaatgaataatttcctatgttagggaaaggatacaaaaagcacgaatcataaaaaggttaatttatctatgctacaatgaagaatatctgttcattaaaatatattactaggccaggtgcagtggctcacacctgtaatcccagtgctttggaaggctgaggtgggtgaattgcttgagcccaggagtttgaaaccaggctaggcaacatggcaaaaccctctctctacaaaaaatacaaaaattagccaattgtggtggcacatgcctgtggtcccagctactcaggaggctgaggtggaaggatctcttaagcatgaagaggttgaggctgcagtgatccatgcttgtaccactctactccaaccttggcaacagagtgagaccctgccttaaaaaaaaaaaaaaaaaagatatcactacaagagtgcaaaggcaagccatggaatatgagaagatacttgccacttataatcaacaaagggcttgtatctaggatttattattcctagattactaaggaaaaggaagacatgctgtggttaaagccccaagattggaaggaggggacaaaaggaaggcttctggtttgctggcaatgttttatttattgacccagatgatggttacatatgtttgctttgtgacagttcaactgaacagttaagtttatgtttatgcatttttgaacaagtgtttgatctcagtaagcaataccccatttcctttttaattatatgatagttttactgatatgtaattcatctatcataaatttgcttctttagtagattcacgaagttgtacaggcatcactacaacataatttcagaacattttcattatctgagaaagaagtctcatgcctatttgcagtcactccccattcttcactccccctagccctaggcaaccactctttcagtttttatggattagtctattctggccatttcatataaatggaatcatacagtatgtaattcctttccaatttttgattcagttgagaaatagacaccagaatcaacagatgaaagttacaacaccagctttgttgttagactggggcttgacttttgggtaaatcagtctgtctaactcagagggggacttgctgctggatactctctcagtgccagtagcagggacaaacagagaaggaaggcaggcagtgtgactgacaactctcaagtgcccttccactccatgcaaatggaacccaggtaacccataacaagcattctttttaaagagtcatggagctttcaagaaaataagagaaatattctcctaagaacaaaatagagataagaaggcattttgctagaatctgaggagcaatagtaagcgaacacaatagccagagctatcctggggacaaatgtccatataagctgggatctgagatcaggtctgggtctgctgcaaggtgagtgaactgaacttagttcacccaatcaacacatgaaaagatgattaaacttattagtagtcagagaaatgcaaattaacattgcacggaagtagctttttttttgcttttttttttttttttttttttttttatgacggagtctcactctgtcgcccagtctggagtgcagtggcgtgatcctggctcactgcaacctccacctcccaggttcaagagattctcctgccttagcctcccaagtatctgggattacaggcatgcaccaccatgcccagctaattttgtatttttagtagagacgaggtttcaccacgttggctaggctagtctcaaactctggacctcaggtgatctgcccgccttggcctccgaaagtgctgggattaccggcatgagccaccacgcctggcctgaaatagcattttttataagcgtatgccctagagaaactcttgcatattgtataagagtcagagagacaaagaatttgttgctatattgtttttaaaagcaaaaactggaaataacacaaatgtttgttttgggtggttagataaaaatattatggtgtattcccacaatggactaccatatagcagtgaaaacaaatgaactagagctacattcttcaacatggatgaatcttagaaatataaatgttgaatttaacaaagcaaactacagaattatgataccatttctgtataaagttcaaaaagacataccatatattggttaaatgtggtaggccaggcatggtgctcacacctataatcccagcatattgggagactgaagcgggccaattgcttgagcccaggagttcaagaccagcctgggcatcacagcaaaactccatctctacaaaagatacaaaaaattagtttggcatggtggcctgtgcctgtagtcccagctaccgcagaggctgacataggaggatcacctgagcccaggaggttgaggatgcagtgagctgagatcacaccactgcactccagcctgggtaacagactgagacagaccctgtctcaaaaaatatataaataaataaataaaatatactttaatatatagtatatacagtaaagttattgttaagaagcaatcgattgataaacacaaaaatcaagataggagttgcctctgagtggggtgaaaggggatgggacgagagagggagcgcacgggaattgataatgttctagttgttggattcggcagtatgttttgttttttttccatctccccccaacacacataatgtagttttattcagttttaaacaaactgtaactcttttggggcagtaagttcatgagtgttcattttattgttaggctttagaactcccatctgtattatgtatgtattattatatattacataatacattatatatagagagagagaatgtttcaaatattacatgatatgatgagaacaagaaagagagaggggtggctttccagatctacctctggaaggcaagtctgagccctggcccaggtgtccttaggacaaggaaacagcagggcagaacatacaggctcagggcaggaaatccctcaaaagatgggaagaaaggggcagaaagaagcttttgcaggtgatagatatgttcattgtcttgactgtggggatagtttcatgaatgtgtacttatgtcagaaatcatgaaactggactaagcaaaatggctccttcctgtgatcccatcattttgggaggctgaggtgggaggattgcttgaggccaagagttcaagaccagtttgggtaacagactgagaaccccatctctacaaatattacaaatcaaaaagtaaattaaaaaaattcatcaagctatacactttatgtttagtttattgcatactttaaacatgtatcatttattgtacaaataaagctattaaacacaaaagccaggaagaggttgaagccatactcttttcccagcctgcccagtcagataagtccgtcttccttccagtccccagattctccctaccccacacacagtccccttctcccttaggaggtacattttatttcttccagtctagtaataggacgtccccccaccaaaaacataaaacaaaaagttttatgaattacttgccgtacactgttgagtgaattcagtttttggttttttttttttttgagacagggtctcgctgtgtcacccaggctggaatgcagtggcacagtcatggctcactgcagacttggcctctctgggctcaaacagtcctcccacctcaggctcctgagtagctgggattacaggtgtgcgccacaacacctgtttaaaaaaaaaaaattttttttgtagagatggggtctccctatgctgcccaagctggtcttgaactcttgggatcaagttatcctccctcctcagcctccaaaagtgttaaaattacagacgtgagccattgcacccggccaatgtgaatccagtttttaaaagccagattctgtattgcctgagagtaagttatctagattggattctctacaattgagaatttgaagataaaataaagtgaaagttcctttaacttaagcattgttttgctcttacaacatgtaaggctgaaacaagtgcccatgggtttgaaatgaagctgtcctgacctagcgttattctcaatgctagatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggtttactgtgtagcctcagaaggtgaagtctatgagggcagggaggtgtgtgtgtgtgtgtgtgtgtactttttaactgctgaaccccagtgtctagaacagtacctggcacacagtaggcattccataaatatttgtttattgattgaatgactgctaaacactgctagactgcggggatgagatgtgtgagaaatgcctcctgatcttaagacactcacagtcaagtggaagatacaagcatggaatcaagtaattaagaaaaatgattctcaggccaggtgccgtggctcacacctgtaatcccagcactttgggaggctgagtggggtagatcacttgaggtcaggagttcaagaccagcctggtcaacatggtaaaaccccgtctctactaaaaatacaaaaaaaaaaaaaaaaaaaaaaagctagacatggtattgcatgcctgtaatcccagctatttgggagactgaagcaggagaatcacatgaacccaggaggcagaggttgcagtgagctgagatcatgccactgcactccagcctggacaacagagcgagacttagtctaaaagaaaagaaaagaaaaaaatgtctctggaccagcagactatttgttagaagtgcatattcttagggtgctccctaggcttactgaattagaacctctcagggtgggcccagcaagctggggtttcacgaccttgcgggtgattctggtgacctttaaggctgagaactgccattgtggatgtaactgtaggaacagtgggggcacacgaggatttaccagcactctggggagtcatggaaaggaccctgtagaggcagaggtgatgaggtggggcctgaggggatccaggggtttgccaggtaaacagtgggaatgagacaaatttctgggaaaaagtgatggagacagactgctgagccaccccaggagcccgcctgggtttggagaagctctgtggggcacttttgacccagatctataaattcccagtcttcatcccttagcctgagaaatcagaacttacacttaaacaaaaaatacaatgtctttctaaatttcaaagaatgggaggatgatggtaagttcataatttgtaaaaaaaaaaaaaaaaaaaaaaaatagctctgccatttgtttactgcctaagtggccacagaatatgctactgtgaggggagctaagtgtaagcatttgcctggcttccttcatcccagtcatgcagaacatacgcaggtgtgtgtattttcattgtattgctgctgaagctttttctttcctttttcaagacagggtctcactctgttgcccaggctggagtgcagtggtgccttcatagctcactgcagccttgactgttttctgtgctcaagcggtcctccccacctcagcctcccaagtagctgggactacaggcacgtgccaccacgcctggctagtttattttttatttattttttgtagagacaggggtcttgctatgttgcccaggctggtcttgaactcctggcctcaagcaatcctcctgcctctgcctcccaaagtgctgtgattacaggcatgagccaccgcgcctggccaagttagctttatttctgggtcaatgaatggtaccaacactctataaacatgaactctatctttagtgacactatgatacataaatgagcttatcgcccctgaatgtctatatctaaacccacgtaacacttgggaaggagaaagaaagaagtgagcccatcttgggacaggagctcctttggtgagtgtagcacagagtgatttgttagggaaagcacatgtctttccagaaggacatgagccagaactttcctggaatacttcccaccaccccatgattctcagaaattggggtccaggccaggatgaacgagaaagaaaccacagttcatcccagtgctgacacccgtacccagagaggcccgggccggggatgtatcccaaggacaaaaggtggagggaggaggctggggggagttcacttcctgtggagtgaatggaaacagcctggctctgcctaatgtgcatgaggggctgggggtggcttgaacagcttgaagtaccttgtgtagtgtgtgcgcacattcacaatgttagaaaaaaacaaaaacaagagctaagcgagaagtctgaaatactgtggtgtatgatgctgttgagttgcaagaaatggaagctcgtgagccgggaggcttctgtgtggcagatcgtaactcctgaccaactttgtttcacccatgatgataaccagcagaggttctccaggttgtttatttttgaacatggtacaattcattaacaaatatttgccagggcttagcttaccatgagccaggcactgtgaggagtgcagttacagtggtgaggaaaaccagacacaaaccctgccctcgtggagcttatcgtctagttggggagatggacatacatcagtattcatgaaaatgaatgaaaggtacacagaaaagaactggcctcccaacaaatacagggacatgttttttcagttcttccacttcacagagatctggtactattataatggcaccatgggctgcacttagtggacccagaaagttctactggtttgggttttttaaaagatatcctacacgcttaagcagggaatcttttggaaacctctggaagaacaatcatattaaacatgcaaatagggctgggcacggtggcgcacaccagtaatcccagcactttgggaggctgaggcaggtggatcatgaggtcaggggtttgagaccagcctggccaacatggtaaaaccctgtctctactaaaaatacaaaaaaaaaaaaaaagaaagaaagaaactagccaggcatggtggcgtgggcctgtaatcccagctactcagcaggctgaggcatgagaatcacttgaatccaggaggcggaggttgcagtgagccaatatcgtgtcactgcacttcagcctgggcaaaagagcaagactatataaaaaaaaaaaaaaaattggaccatgacccttaacctcaagattctgtgacttgtcagggtggaaaaaaatgtatgtaaataagtatagatgtgataagctttaataaagagcaggggaatttagagaaactgtaccaagcattaaatgtattatttttagtaaccagaaattccttctattgatgtaattaagattttatagtgtttgagaggccaaggcaggaggaccacttgaagccaggagttcaagaccagcctgggaaacatagcaagaccctgtctctccaaaaagaaactaaaaaattagccagttgtggtggtgcacacctgtagtcccaagctgctagagaggctgaagcgggagaatcacttgagcctaggagttcaaggctgcagtgagctatgcttgcaccactgcactccagcctgggtgacagagtgagacactgtttcaaatagaaaaaaaactgcatatagtactttactctcagatatgagtgtttctgttgaccaggaattttaccattcctggttctctgatgcggaggtggccttgtgaaaggacacagtttctgctgagctgaacacgctttagtgtaatctgatgaagaacttctatgctggttgcggtattggtggaaagtgttttattttgcagaaaaagcacaaattccacagagggcaacagttatccattcactccatagctatctattgctgcatgacagactaccccctaaaacttagtggcccatgccactattttattttgcatgattctgtgagccaggaatttgggcaagattcagcagaacagctctactccctgtggcactggctggggtcatggacggttgtgtgccactggtgggtcagttgagaggggggcccagccggcacagggacagtgaggctggaccatccaaggggcttctttcaggtttctggtgcctcagcttggatggctgaaacagctggcagctggccagggctctccagcagggtggccagacctctatgaggtggcaagggctctgaaagtgaatgctccacaaggatgggcccagtgtgtcccccttgcatcatgctggctcatggatcactggccaaggccagtttcgtggccacacccagagtccatgtggaggggcctgcacaggacatgaagccaggaggtatagttcacaggggaacacaaaagtaacgttcactgcagggacagagcagatcactgaagggaatgccactgggaatcgagccccatgtcctggcccctgagcagagttctgtccccaagaccattactcctcatggaacttttcacctccctcacacttacggcaatgctaacagtcactacacacggttctgagaaccttcaaattgaagccctcatgatgtttcctaagaagttgcagttgtccaaatccacaaacccagattttagttggcaagtctgagaggttctgggtaactgttttgctgcacaaacgtgggtattcctgaaagtttaaagattcatcttcaacatgctagggaaagccaccatgatagctagtctaataatgcccagaccatcccctcattgatgaatggaaggctcacattttaagatgaatatgggccagggaggtttcacctttcttggctgaggttgatgccaaagtgataaaccttggtgcttcccgcctccctgttccctggggatgggccagaatcagatgccatcagggaccctgcaggcaattctgagaattccttttaagaagacacctgcaggaagggtgaaccgctttctagcccttctgcagccagccactccccctgccttttgatgacacaggttctgcataaggtgagagggaggacagggtgacatccatttcttgtaaaaatgcctcaatgagaaaagggccacatgcatttcttgtaaaaatgcatcagtgagaaaaacaacagcagcagcaacaacagcaaatatttactgaatctcctagtatgatccaagcccccaaatcaagaaaatgtgaatgctgatgtaaaaaaggaaggtatttgttcaaactgcctggccagtgtttttgaagaaaacagagatctccagagaccccttttttggtcctaagtagcaagcaaacaagttcattaaatgtgtactgtttatttgtgatgtctccaagcagagtagttggctcttgttatatatctgggagaataatcaatgatttatgcttctgacagtcttatcatagccatttacataatggtcatgtgtatttgtgactttaataccctctgcatatagccttaatttttaaatggattacactgttttgctgttgtgactttgcttgtttaatcatagctaagacttttctgaagtcaaatactttttccattatcacagtgaggcgttggcaaaaaagtgggggcttgctggttacacttgctgaaaataaatcttgcgtttatttggactctcaagattggagctctgaattcacatagtccagtgtttatgcacagagcaccactggcattgccattgattacgactggcatgaccactgccagaggtttagcagccctggcacacatccaccaaatgccatttcaatcactcagaaatttctacaacaacagaaggccccccacatgttgggatagtgggctgcccttgcttgagcacagctgatcgatccaaccactggtcagcggttgcatctcctcttcaacactcccctaaagggacagatcagccgggctctgctccagcatccccagcgatgaagaagtcaccacctcctgaagccacattggcctgtcctcattattaacatgttatttttatggagtaaactcctcccccatcaccccctcagaccttgtctataacacaggcctctttgtgtctcctcccctacaggaatgccctggagtacttgaaagtagccattgtgttcctgctgtcctgtgacagcctcccacctctcctggaaacttactgtgtcattgtagctaggtttgcattttacagtgaagcattttttacttcacctcattaaatgttcacactgtgaagcagggattagcatttccactgtacggataatgaaatggagtctcaggttaaacgacttacccaaggctacactgctaacgattggcagagccagaacatgaatctgctccaaattcaatgcctttcataattttcccaatatgcacttcatttttttttcttttctttttgagacagaatgtcactcctattgcccaggctggagtgcagtggtgtgatcccgactcactgtagcctcgacttcttgggctcaggtgatcctctcaactcagcctcccgagtagctgggactataggggcacaccaccacaccttgctaatttttgtattttttgtagagatggagttttgccatgttgcccaggttggtctcaaactcctgaactcaagcagtgtgcccacctcggcctcccagagtgctggaattacaggcgtgagccaccgcgcccggcacaatatgcaattcgttttgtccagcctctccctctgatgtcttcattcttcccattacaactccgcatgtctcctgtggtggaaggcatcagtggccccaatttttcacccttccctttcacatgttttgccagttccatcagcaggtggaacttgttgggggactttgttttcaatagaataagatggaaatgtcctcgtgtgagtttcgacattaggctcaagaagcctgtgtgtttccactttgcgtttctgccatcaccaaacatccggagcagagccaccccagctagcccagccgagattaggtgactcccagccaccccacagacttaggaagaaaacattggttttatttaagttattgcgtttcagggggctggttatgctgcagttgctaagcaatacatttctccaactttcaaaaagcttccctttccccacggggttcctttcccttcattacttggaagcctgtgctagctttctcaacatcctcctcctgtttattccacaaaccactgctgcctttctgctccccctccccatgggaaggtgctccccaactcctagtggcctaaccctgcttgggccctgggccttcagtgtgcagcatcaactcgtcctgaacctctccttttttggcttcataacgcttacctcttgtcggcctcgacctgttcttgtgtttcttatctctctcctctcctcccatggctcttcctgggccctctcacctctttgcttcctctccagggcccccatcctttcccaggacctcgaggaccaccaaagtgctgacgactgttcccagcctgcgtctcttcccaggtgcagctgtgtgtgcacgcccctagaccgctcccccgggggcctgattcacagcaatgatcaccagcacgtgaggaaagactggcgtaggggagagtggccagggttcccgccagagaggtgttgcaggagtccaggcgagaagcgatgcggcccaacagggcattagggtcaccagaaccccctgtctgggcacccatgcttctacctgcagagctggagttttgtttgcagaccttagtgtgggacttcacatttatccttattaaatctaggcatggtcagattgcacccaacactgcagcttgtcctaccgcttgctaattttgtttcagacactaattaggcgtcgctctcagagaccagggtcactcaggcatttgatcaatgtgttacttgtgtcccatccaagtcatcgataatgttgaatagaaagggcccagcaggaacacagtaaagactgttacttgttttagccactagagggctgcatgtcccagaaattgatgcaggtgctgcttagaagtgaaactaggaaatgtgagcactgttgggttctatggggtttggagtttccagggcgggggcgcagaggagagtgtagcacactggggagcagcagatggttgtagcattcgtgggcaaggagagggaggagtagggggttggcagagaccacgaagggccttaggaacacttctggggagcaatagggagccatagaaggactttaagcagaggccacacgatcatatttgcttttttttttttttttgagacagggtctctctctgtcacccaggctgcagagcagtgacatgatcacggcttactgcagccttcaccttttggactcaagtgatcctcctgcctcagattcctgagtagctgggattaccggtgtgcaccaacacacctggctaattttttatttttatttttgtagagacagtttccaggctggtttcaaactcccgggctcaagcgatcctcccacctcagcctcccaaaatgctgggattacaggcactagtcactgcgcccagcccctatttgcatcttaaagcagtcactccagcatccgtgtggaatggagggaggaagaagggaattggatggctgctggttggttcagaatgagaaatgataaaggtctaaggtgacatctgaagggaataaaggaggggacagaggaatgtaagtgaactgagcagaatgagggcagagtggcaggggacagaatggcaggagccacccaacaggaggggagggggagggaatgggagggaagggagggtcacctggaagatgtgagggggccagggagtgaggagagaaagaggaaagtgaaattgtgctttgtaaagaatgagtcgtacattcactcacgatagagcatttattatgtcgcagacactgggctagaccctggggatacattcatgagggaaacagacactgcccctgccctggagttttgcaccctagtggagagacagcaggtatttggggcgggaggctcctgtgctgggcctgggaagcccagaagtgggtatttaagctgagagagcaaggatgagaagcagcagccggtgaagaaagctgggaagactattcccagcagaaggaacggtatcagggaaggccctttgggagggatggaaaagcagccaggcttgctggacttgttgcaggaggaaggctcggcctgatcctgtgtgctttaaggacagtggtcagggctttgggtttgattctgtgcatcaagggaagccactagagggtttgggggcaggagagaaccatgaccagatgcgacctatgaaaagatcactttggatgcttgcagagatggggtgcagtccaggtgggagccatgcagatgcagagagctgctcagatgggacacaagtctcagaagcagaaatgctgatgaattggctgcaggtgagaggcagagagaactcatgtgccttcctgggtttctggcatgaacaactgggggaatttcaggggcatcagcagagctggggaagccaggtgcagggagtgacaggaagtcacatgccatattttgaactgtaccttggagagagggagcctgagaggcatccagccagcaggtgagtgcatgcatgagcttggagattgccgaagtcggcccggagccacagaggtgggagccacggtggggcacgcacagaccacagacctgaagccttgcaggaagacagggagatggagaggagatgcgcaggagactgagtccaggcacaacggtgctcagtgctcggctctgaggtggaggaggctgagctgagagagcacaggagggtgaggttgcctgggcgacaggagaggagagggcctggagaagaggccaccagctctgtcacctgctgctgaggggtcagatgagcacaggaaatcgctactggatctggtggctctgaggccctggatagccctgggaagagcatcttccagggaggtggggaagccagagatgggtgggttgtgaggtacatcacaggtgaggaggtgtagcccattcgtggagaaattggagaagttttgccctgaaggagggcagagagacagaaaaggggctggaggggcagctgagggataaatggtgcttttttgacgggtgacgcacatcttgtgcaggaactacctgaaaacttgtgaagacattagaaagaagagccaagacccaagaagggaattgaaggtgcgagggaaactgtcatgcccgccctgccctggccttcttatacgggtgcctgttccctggctgcaggtcacgtgccacatcttgattctgatgggcatagcacattgacaactgaacaaagccacccggcttggaaatggtccctggtcaaggtgaaggacacgcctggtgctgccagaggccaccaggcagctgcaggcacgccctcttccttcctcccacacgcttggtagcacagagcctcattcatccaggccagcaggtcacagccatgggaatgtcatgctcagttcccagggaaaagggcagaggctttttcccctgcagaagaaccagtctgcacctagggccttgcccgttttccccaagagtcctgtgattatataagcatcatctgtccctgatgctggggtcctggtcaagacttccccagggcggggctggggtgacacagctaggccctggcctggagttcaaccaccctttgtcctgatggcactttataaaaacactgtcagcctggtctctgggataacagggttacaagcctctggatgactaattggccctcagaactaactggatcaaatacaaactttgggatgatattgcgtgcccccaggccaggtggagacctagactgagcatggacactgccatggagaaaggacatgggaaccgtggggtccccctgctgcccagccacccccacacctcgggttgaggtgggatgtaggttacagataaggttaaaatacaaatggaggcaggtgaaaagttgggtgggtccggaggtttgaatcgcagcaaggaatggatcgcttcctcttcacccagacctcagctgctccctaaatctcagtgaccgccaaatcggtgcctctggcccacgtctttcttgagccccagactcatttgtccaacggctgcctggacatccccacgccacgtctccaggcacaggacactcgtgtgcctctgccccccatcccgggctccctgtcttggctgagcacatccccttctactcaggtcacccacgccacaggcccatgtcctccagaaatggttcagctatgcctggtcaatagtaaatcctaagtatctcccaagttctatggctgctgcctctgggctctgggtttgaatcctgcaccaccatctgctcactgtataattgggtgagcaaccctctcagtccctgtttccatgcctgtaatattgggattgtgaaagatgtcataatcagaatggagccacttttgttaaaaacaaatcctgacaaatagagccaagggaaggccatgaagagaaatattcgcatgcataaatgcctaataacaaaaactaccacggcagactatgaaaactgcaaccttgcacaaaaaatgcttctaggaggacagctgcccagtaactacctgtccagccttggactggtgtccctcttgcaattaacccttgcagccaaggatcattacttcaaagcaacaatacagtcctcactttccttcacctttgccttccttcatctccctgaaggcacacgtgctttttactctggcaggcatactccctggcagtgccctattcctgagtaaacatcactttctttgagagccactctctggttatttaggttgacaggataatcacagtacgcacctcataaggtttctgaagactgatgttaatactctaaagcatctggagggggactgccagcagcaccgagttcgcactcgctgttaccagctggcgctcatcatcccaccctccctcattgttccccctccaggcccggctccagagctctcccccaccagacacacaggtgttcaggtcacttcctgaataaaggccagccgccttaatgatggcgtcagacccttagctgggcatttaaggctccctcccggccctctcacatccccacatgccccggacaaagcgcacacgcctcgtcattttccagccatgcttcgtgcccacggccctccctgcagcgggaatctctcgctctggtgacggggctaatgtgggcgccgaatctgagcccggcatgtcacctactttacctcgttggttcccacaacaatcctgtgaggcaggtcctcttttggcctgtttcctggaagctcggtgattctcaagagggaacagctagccgtggagccaggatttcagtccaggtgtggcctatcccaaagtccaggtggttctagttaatccacacaaacctctcatgagtagatgacatttcaaaggaaaaagggacctgacgtctccgagatgggaaaggatggtagcagggtgtatgtcagcatctccccagggcagaacacatctggcggcatctgcaatgtctgttttgctaagcatgagcgtgtttccacaattccctctctggcaggtgatgaattagagttggtcccaagagcacatcgtgtcagctgtgaggggaggtgaactggggcgggccccgtgtggtcacagctggctggcgttgtcagagacctctggctccccttgttgtcagggttccccattccctgcacctcccccttcagcttcaccactgtgggcccagtgtggggggctctgcactgaagggtgcctgcccttctgtaggtccgccatgtcctcagggtcggcagagggatctgcccttccccccgggctcctcacctcctgtctatcctcccttctctgctgactcggccccagtgccagctgcaggggacagacttacaaaggcctctgattcccctgccccacgagctccaccaccacaggaggcctacagtaaccccggtgtgtcactcggggtcctgtcccaggatccatccctaaccagcaaggagaatgaattcaacagatgttaaatgaacaaataaatgagtagttgaatacatatttttgctttacagctttaaatatcagaactaaaactaaaagtgatcttattttttccaaccttccctaaaggataaattatcaatgtatattgcaacatattctccaaagggaccctatgatcacagtattttaaagtaacacagatggctctcagtggagtgattaaattgcatctatgttacattggttgatggtaaaggggttgcggctttttgtgtgttttgatggcgactttattttagggtattgtaactgcacatgctcctccatgaggaggaagtgatgagggaaggcggggaccctggcaggtattggatgtgcatccaccatgaacttcagcctctgtagccccatggtgctggggccactgggaaatggtggaatggctggctgagtggcaatcgctcctgtcaggaaatctaagctaatgttatgtccaactgaaaaagaaagccaagaaaacaaaacaggtgcagaattgcaatctgaaaaaattttttaacactttaattatttaattttattttctacagatgaagtctcgctacgttgcctaggcttgtctcaaactcctgggctcaagcaatcctgatcccccaactctgccatacccgccccccatccccagcccacccccatctccacctcccaaagtgctgggattagaggcataagccactgccaccgctgcaatctgaaattaatgcctatgtcaagttgaaggactgctcaaaatattggagaggttcaagactgaatgtccctacgctatacagaggtctaattagatcttccaaacatcagacaaccaagtgaagttaagttacctacccccttgaatgaatctagcttttgaaatctttccgctgagttatcctttagcgctggtatccagaattcctttttccgtgggggctgggaggagatgaagttatctgtcctgggacagagagctgaagaataggccgaggggcctgaattcacagcctggtttccaaagacatggaccttggggtcagccctggccctaaatcctggctctgtggccagctgtctgatctggagggagttactcaccctctctgtggtccaagtttccctccatcaggtggagactcgagtgagatgtctgtgcaggcttagtgcagaccagaccgaacactcagcttttctctgcttattatggcagctacataacagcagtttccatgtttcaaaaacaaaatcacaccttgtttacatccatcttcaatcttttcaatctttttatgtagactaagtctagcttttcagggtatcccaatagtatatgtttcagacctttatctaactgtgagcccccaatacaatatccaaaacctttctgaaagaacactcatgaagagatggtgttcattcatgccacatgtataatattcttttggataaaatggcaaaacaagtaaaagacataaaatcgtaatgtcctctaatacaacaggccagcaagatttgtaaatctgttttgaaacaactatcttttgacattaaaaacgattccaggaatctttgaatttcattttccttcacattgttacaatcactttcagtcttatataatttctagactgtgctatggctcacagcagctgtgtctcatgggaaatgcagacaaaccagtctggctggtgaggggggctgtggaaagctcacagcccctccttggacagccacattgctcccccagagccatcaaaggaggtccgcctatgaggctgagggtctgggacatttccaaggggagggtgctcctgagtgttttctccaggagcaatcctaacttctgggcagatgcctggctctggccaagagcctcgtccaagaacattatgatctcagtccctactggcctaacgctaggacgcttccagctggggaacctcccaggcagcagtgggggagagttccacatggtttctgatgccctggaccatccctagttcacagccttgacgatgggacgggtgcagggtcactggttggtggggcatacaggaaggtgtgctggggccctggggcagcataaggctttccctgcctggaacggtggcaagaacaaacacagccacacacatgcaatggaatgaaaccaaccaagaagtgtgtggtaccttttatttagtcagtcttcatttaaatgtgtgcttttgaaatcactaaatatgaccttttcagaattcaattctcacagtatttacagtgaactttgtgcaaacaaatccccctttgtgcaaagggggagcttcctgctccccctttcacattaataacttacaaattcagatcacaacaaaaccccagactctagttttctgtttgaaaggtactgagctgggataatgggttgctaggaaagagctaatgcaagcccaaaggaaataaaatgttttctttatcagaaaagaataataacaaggcctcactctccaaaggaaaacagacgtcccaagatgttgtggaacagtattaagtaaccaaatacaattccaatggttatttcaccttcattttttatacttacactcatctcttttaattaaataagcgaaaccagaaaagtgcaattcgaagggactctgaactgtcagggaacgttataaaaataatctgacgtcagtgactaaagagtacgggtcatcaggctgccggccggcctcctgcaagggcactggccagggaggccacagctgccaaagcggggaggtgcgccaggccccacatcacctgcctcggggtccatgccaggcaagaaagaaacacacacctgggcctagccaagggtggtgccctgccaggtaactcttcaggtacaaaatctacaaaggggatcagtcctggagaacacatttctcttcccctctctaggcagagaaatacctggctgaagaaaaactacacaacactcaagtaatgtataagggagggttcctgtggaaggcaacgattcatgatttagaaactgaagtgtaaaaaatacagatcaacaattgtgcctttcattcttgtaaaatatcgctttaaaatcccgttttagatggttgatgtctgaaacgaaaccacggccttttaaaatatttttgattccaagcctttttataaggaagaggaattaacacctcaatcatcctagtcacaagagactattcaggaccaaaactgtataggctttctatgtgttcactaaagactgtgatgggcaattatagaatgacagcttattagaaaaaaattgcttttatcaacatctgatacaatggctctgaaaaaaatttattgatggatctgagaattttttcacacatgaatcatttctccttccaatggttattgatactgatagaagttccccgctgagactccctggacccatggtttgtgcctgctgggcatcccactatgctgattcctactctaaaagacacttacagcagaaagcattcacccatgaccattatgaaggaaatattctgtccctcactcaccctctggaagctaatatggagcagcagtcactctatccagagccacatgttcacagttctctagcaagcaggtcacaccccgtgggtcccctattccccgtgacccttgttgatccatcctcttcctgctcagttgctcccctgctcacctggactgcgggaggcatgggtgcgcccactgaggccatgctgaggagctgggatggaatgcaggacagggagagaggggagactgagctgagagggagcactggatcctgggaggtgtggatgcactgattacagtccaaagacattggcagcaacaaaggacacacaatgactgaaaacattaacgttaccttctgggatctctcagtgccctgagcgatctgtgtgtctacctacagatgggcaaagcatttttgcaccctggccccattcccagttctcccctgagaactcagtcctccttgaagacttggtgatgcctgtcaattgagctcccatttagcggctcattgtgcccaggggctcacatctgcaagttaaaattgcttttatcaacatctgatacaatggttctcatttcacataaataatcacagacttgactaaaatgaatatattattctaggttaatttttttccattcaaatgtttatactccatctacccagaacaattacagcagaaaaaataggcacctccaaagtcttcccaagaatgatgactttctgaaatgacacactgtacaaactggacaaatgagacgactgactgtgacaggggccggggagctcttcaaggggccgttttcttcaagtctcggatctgtttaatcaagtagttcttctcgtcagcgaactgctcatcatccgtcctttctttttggaagctgctcagaaactcaatgagtttgggctgattttttaacaggatctccacaataggctgtgttttgtgaggactggccacaaacacctgaaacaaaaagaaacaaatacttaggagtgcaagccagggacctcacccacgctacagcagtgcaggccagggacctcacccacactactcgcgtttcatgcgtgactgatattattaatgcgtagaagcccctgactctaattctcagtgagggtgatcaatacagtcacacaccacataacgacatttcagtcaacaacagaccatgtatacgactgtaatcccatagcaccataatggagctgaaaaattcccattgccttgtgatatcgtaggtcagtgcatttactcatgtgtctgtggtgatgctggtgtaaacaaacctactgcccggccagctgcataaaattcaagcccgtacaattatgcacagtgcataatacttgataatcaacgacgatggtactggtttacgtatttactatactatacgtctaatcattattttagagtatatgccttctacttagtaaacaaaaagttaactgtaaaacagcctcaggcaggtccctcaggaggtatccagaagaaggcactgttatcgtaggaggtgacacctccatgggtgttatggcccctgcagactttccagggggacaagatgtggaggtggaagcagtgatactgatgatcctgaccctgtgtaggccgaggctaatgtgagtgtttatgtcttagtttttaacaaagaagtttaaaaagtaaaaaataaaaaactttaagcacagaaaaagcttatagaataaggatataaagaaagaaaatgtttttgtacagctgtataatgtgtttgttttaagctgtgttattgcaaaagagtaaaaaagttttaaaaaattaaaaaataaactttttataaaagtaaaaagttacagtaagctaaggttatttttatgtatgtatttatttatttttgagacaggtctcgctctgtcacccaggctgacgtgcagtggcactatcagagctcactgcagactggaactcctgggctcaagcgatcctcccgcctcagcttccccagtggctaggactacaagtgcatgccactgcacctggctaatttaaaaagtttttcgtagaggcaggcctgactatgactgccaaggctggtctcgaattcctggtttcaaacaatccttccaccttggcctcccaaagctgtgggattacaggcatgagccaccatgcctggccctaaggttaacttattattaaaacaagaaaaaaaattttttaaatcaatttagtgtagtctaagcagtgtttatgaagtctacagtagtgtacggtaatgtcctaggccttcgcattcactcaccattcaatccctgactcccccagagcaactgccagtcctgtaagctccatttatggtaagttccctatacaggtgtaccattttttctcttttatgccatcttgttactgtatcttttctatgtttagatacccaaataccattgggttataattgcctgcagtattcagtatggtaacatgctgcacaggtttgtgctctaggcgcaatagcccacactatatagcctaggtgtgtggcaggctccaccacctaggtctgcgtaaatgcactctgtgatgttcccacacaaaggacatcgcctagtgagcatgtttctcagaacaactccctgctgttaagcgccacaggcctgcacttcacctttcctatcactctcctaagtcactagctaggagcacgtgggagctatctatgaacatttcatatttgactttgttttacttttaaatatttgttcttaactataaaatctttcaaacagaaaataacataacaaatccagtatacgtacctcacaaattgaatagattttaccattgtgcctcaagagtctctttttaaacaaataaaacattacaaatggaaccaaaccctcaccttccacctttcccctcccacctccagcagtgtgccaccatctctgggcacatttcaatccttatcctcctattacatagatatttaaacataaacaacatatagtatgaaagagcttatgatttttaaacataatttattttttgaacacataatatcatcacctagttcaaaattcaaaaaggacaaacgtgaatagtcctcctctcaccttccctccctggaggtcaccaatgtcactgtttgttacatatgtgaagctttaaaaattacaactgctgggccaggcgcggtggctcatgcctgtaatcctagtactttgggaggccgaggtgggcggatcacgaagtcaggagatcgagaccatcctggctaacacggtgaaatcccatctctactaaaaatacaaaaaattagccaggcgtggtggcgggcgcctgtagtcccagctactcgggaggctgtggcaggagaatggcgtgaacccaggaggcgaagcttgcagtgagctgagatcgcgccactgcactctagcctgggcaacagagtgagactccgtctcaaaaaaaaaaaaaaaaattacaactgcccaggtcctacctcccagatacgtcaactcagcaggtctgtggtggatgtctagcattctgtatttctatgaagttccacagagattcttatgtgaactcctggtggaaaccacgatctgatactgactggtgcactattttgtaaaagacacactccttagttactgctacatacatgaccacatgaccagaatgcagatcaaagtgtctctgagccctacagagctctctggtgtgatggtctggcctcctgcctctgcctggcaccccctctgcccacccatccctgtcccatagctgtgcagtgcccaactctacagggaacacactatgaaagggcttagttatggggcagtgggggtttcatggctaagcctttaaggttcctccaccctagcaagtgtggggaaggagaaaactaccctaggatgttgagtaccaatgtggagaatacaagactgcagaggctcccatcccaggaggtggcgatgacattacatttccgggtttggaacaggaaggctcatggtgtgggcggcatgagagctagtccatgagtcaggcagagaatgtttacacgtggtggtaagaaaagcagcattccaggaatactgaattgtcccactgcaggctctgaggtgggcgggacaggacgtgggagcaacagtaagaatgagtaagggaacgtgggagctaaggcggcgccggctctggaacctgggttcaaattccacctctcctacatgttagcagtgtgtccaccagcaaagttttgttatctagaaataaaaggacctctgcctgtctgggtggggagaatgtgctggagaacatcagcagcttcagcacaagtaagtctcctgaaagccttctgttgtcactgtatgtggggagtcgtgcttgctggaggcaaagtgcctgaactgaattcaaggcctcgtcactgccccatcaccctaattctggtcaactgtacacacgaccgtgggcagccagttcatagccctcccagctggttgtcttcattcatggggctaagtgtttcacactcatcgaacacttaaccctcacaacagccctgaagtataagagctgttatcctcatctgttaataaggaaacaggctgagtcatattaataaacttgaccacatagtagtatggttaacagcgcagattcagaagcacacagcctgggcccaaatcctagcaccatctcttattagctttatgatttcacaaaacttgtttacctctctgtacctcagtttcttcatctgaaaaatggggatgataacagtacctgagtgccattaggtaactgtgaggcttaatgagaacagtatatgtattctactccatgcattcaaatggtacatggcacacagcatgcaccattcaaatgcatggagtagaacacatacattgttgcaaaattgcttttgccaggctcacagaactagcaagggctgaagctgagattaatcccaggatgcttgttctgagaactgatgagatgtgacattttaccaggtgaggttcagaactagaaatcaaagcccacaaatctgatactcagttcatttggccaatttagttctgaaattgttcataaatatgatatataaattcttcatgtttctgttctttccatcaaaggtcatggactcactcacacagcaagtgctaaggaatacagaaccctctctgggaacactgcacgtccctgtggtcacgagtggctcatgatgagacagtctcttggcagcccacatggcttacttacagtgagcccaccgctcagccaggccaggggacccataacagagaaggaaaagggtttcctaagcttctgcttggtgggtctacagccatggggtgacaaggaggaactgacctttgaccttctgggttataaagtatcctaggctcctctgaaacaaccaatgggaaatagaaatcacaaagaaaattagaaaacactttgagacaaatgaaaacaaaaacaaaatatatcaaaactcataagatgcaccaaaagcagtgctcagggggaaatttatagctataaatgcctacattaaaaaagaaagatctggactgggtacggtggctcacgtctgtaatccagcagcgtgggaggccaaggcgggcggatcatgaagtcaggagtttgagaccagcctgaccaacatggtgaaaccctctgtctactaaaaatacaaaaattagccgggcatggtggtgtgcgcctgtaatcccagctattcaggaagctgaggcaggagaatggcttgaacccagaaggcggaggttgcagtgagccaagatcgtgccacggcactccagcctgggcaacagagcaagtctccatctcaaaaaaaaaaaaaaagaaaagaaaagaaaagaaagatctcagattagtaacctagttttatagcttaaggaactaggaagagaagaacaaactaaaccaaagcaacataaggaaggaaagaataaaacttagagcagagataaacaaaacggagaacaggaaaatgacagaatcaatgaacccaaaagttggttctttgaaaaaaattaataaaattgataaacctttagctagattgactaagaaaagaaagaagactcaaatgctaaacattactaatggccttatagaaataaaaggggattatgagagatgctatgaacaattatatactaaaaaattagataacctagatgatgacatggccaaattcctagaaacatgcagactacccaactgactcaagaagaaacagagaatctgcagacctctgacaagagatcaaatcagtaacttccaacaaaaaagagaccaggaccagatggcttcactagtaaattctacctaacatttaaagaagaattaacacaaatctctctcaaattcttctgaaaactgtaagaaatgggaacacttcctaacttatgatatgaggccagtattacccaaataccaaagccagagaaaaacaacacaaaaaaactacataccagtattctctatgaataaaaatgcaaaaaatcctcaacaaaatactagaaaaccaagtccatcactatatcaaaaggattctataccatgaccaagtgggatttattccccagaaatacaagggtggttcaacataagcaaatcaatcaatgtaacacatcacatgtactgggttaaactgtgttccccaaaaagatatgttcaagtcctaattctcagtatctgtgagcgtgattttatttggaaacacagactttctttacagatgtactcaagataagatgaggtcaatactggcttagggtggctttactccaatgactggtgaactctggacacagagacgcttagggatatagaggagaacgccatgtgaagatggaaacagagatgcttctataagccaaggagcaccaaggacctctggcaaccaccagaagctgggagagaagcaaggaagattctccctgagagtctccaaaagaagtcaatgctgccaacaccttgattttggacttctggcctccagaactgtgttttctgttgttttaagccattctgtctgtggtactttgttatggcagcctagaaaactaacacaagtgtaccgcattagcagaatatagggaaaccacatgatcttctcaattgatacagaaaaagagtttgataaaatccaacaccttttcatgataaaaacactcaacacggaggctgggtgcagtggctcacacctctaaacccagcactttgggaggccgaggtgggcgaatcgcttgagcccagatattcaagaccagcctggggaacatggcgaaaccccctctctacaaaaaatataaaaattagccaggtgccgtagtgcacacctgtagtcccagctactcgggaagctgaggtgggaggatcaattgagcctgggaggttgaggatgcggtgagctgtgatggtgccaccacactcccacctgggcaacagagtgagatgctgtctcaaaaaacaaacaaacaaacaaaaaacactcaatataggacatttggatattcacatgcaaaagacgaagctgagcccttatcttactctaaataaaaagtaaaatcaatcaaagacctaaatataagagctaaaattttcacaggaaaatacagggtaaattttcataatgttggatttggcaatggtttcttagatatgacaccaaaaatacaagcaatgaaagaaaaaacaggtaaactgaaccaaattgaaaacttttgtatatcaaaggatactatcaagagagtgaaaaaaacacacagaacgggagaaaatatttgcaaatcatatatctgatcagtgtcttgtatccaggatatataaagaactcttacaacttaacaacaacaacagaaaacccattccaaaaaggggaaaagaacttgaacagacatttctccaaaaaagatatacaaatggccaataagcacatttttaaaatcctcaaaatcactagtcattatggaaatgcaagtcaaaatcacaatgagataccacttcgcacccactaggatgactgcaaaaacaaaacaaaacaaaaaaacaaaaacaaaaaactctgacagtaacaagtgttgcaaagatggatggagataaattgaaaccctgggccaggaatgatggctcatgcctgtaatcccaacacttggggaggctaaggtgggaggatcacttgagcccaggagttcaagttcaagaccagcctgagcaacacagcaagaccctgtctccacaaaaaattaaaatattagttgggcattgtggtgcacattgtagttccagctgctcaggaggctgatgcagcaggattgcttgagcccgagaagttgaggctgcagtgagctgtgattccagcccgggtaacagagcaagactgtgtcaaaaaaaggaaaggaaaggaaaggaaaggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaagggaaggaaaggaaaggaaaggaaaggaaaggaaagaaagaaaagaaattgttgctggtgggaatataaaatgacacagcctctgtggaaaattggctgttcctcagtaagttcaacaatgaattaccatattaccgagcaactcctttcctaaaaatggaatacattgttcaaacaaaaacttgtgtagtagtgttcatagcagcactatttacaatagccaaaaggtgcaaacaacccaaatgtcccttaactgatgaatggataaacaaatttgtggtatacccatgcaatggaatattatttggccatttaaaagaatgaagtaccgggccgggtgcagtggcttacacctgtaatcccagaggccaaggcaggtggatcacttgaggtcaggggttcatgaccagcctagccaacatagtgaaaccttgtctctactaaaaatacaaaaattggctgggtgtggtggcagatgcctgtaatcccagctactcgggaggctgaggcagaagaatcccttgaacctgggaggtaaaggttgcagtgagccgagatcgtgccactgtactccagcctggtgacacagcgagaccctgtctcaaaaaaattaaaacaaaataaaaaaagaatgacgtgctgatggatcatgctacaacatggatgaaccttgaaaacagtgtatgaacaaaacaccacacaaaaggccacacactgtatgattctatttatataaaatatctggaataggcagatccatggagccagaaagcagactaatgatcgccaggggatggaggtgaggggcaatggggaatgactgcttactgagtacagggtttccttttgggatgatgaaatgttctggaactagatattggtgacagttgtacaacatcgtaaatacactaactgttactgaattgtacactttaaaatggttaatgctgaattttatgttatgtgaattttaccacaataaactaaaattgttacttatattaaaaaaaaaaaaaagggactccaggcctgtttatacaaactgcctgatgtttatgtaatacctatcagaaatgtgtggctgctctggttaccatttgtttacaagggagttgctgtgaagttttagctaaaaattgcctggcattttgtggtgactacataaataactcatgacagtctttctttcttaaaaaaaaaaaaaaaaagattaactataatagacaaactgatgttgcaaaccaaaataatagacaaactgatgttgcaaaccaaaataaatgtaaaatgtactggaatttgcagacaggcatcactggttcaattccactgaattcattcactgtaccataaacctaaggaaaatgctaagtttgtgcccaggttttaaattttttcttgtttttattttttatggcttctgaactctgccgcctctaaaagtagttgctgactggagtcagctaatgcaatagtgcatgattcccttggggcagccaggacactggtcaaggcctgagattaacacactgatgataagaaacacacttctaattcaaggtatatggaagcaagtcttttgaatattatgtccagggtagaaatttttttggttgtctttgttgtccctgttttttaaaaaatgtaattttcaaaccacccccaaacaaatgaaactacccaggacttctccttttagaatgccgccttattgcctgtatccctcagtttacataacatgcctgagagatgtgatctgtggagttctcaggcgtggtgagaggaaggcaaatatcatgaccacaactcaaatatttttagtttagaagactgaaaatattgcactctccattttaaaactgaatgcatttcatggaaaataaaatatctacatcttacacacatatccattaatttcattcaaattctattttgccaacagggattgagccagacaaggtatggggaggttagtcttctgcgttgctgacctcactgcctttgatgcgtgctgcaagcctggaatgctctgtatatgctcctgttacggttatgtggaagctactccaagcaaaatcccaccccatcgaagtgtcaaataaggcaaccatgtccttattcatatgactacacatctgagtaataatttagaatattttgacacaatacttgctagtactgatcagagacaattaactttttcctgtttaagaaaggacttgattgttaaatctgcaagctggttgggtgtctataagcatcactgggcccacgacagaattagactggaccccactgcacatcaagggaggaagaaaagccccaggaaggaagtgagggtggtggaggccagcagcctgaaagtacaggatgctctaaaaacctctagaatctcctgaaatcctcctcctcactgccaccattcttaccatcactctgattacacaagtgatacatgtggaaaactagtgaaataaagaaaagcacaaagaagaaagtaaaaaaatcactgacataattcctccacccagagataacccctgtgaatatctggtgtatgtatgtgcagcatttttttcttgtgcacgtcactatttgtagaaatattttaaacaaaactgggcttgcattctgtacatagtactttgtaaactactttttccttaacaatatgttttttaatgcttgtagattcttcttacattacatgagatgatcgccatttcaaaaagatagatatcatctgctgaatccttgctatgcactgggcattgtgctaaacagtttatacgaattgtattcttttatcttgacaacggctctgggaggaagatacaatttttccccaatctccaggtgaagctgagagaagttaaagcagcatccctgaccactaggctgtgtgtgcagcgtgcgccttccgggctgtgctgggtgcttccgctagtgactacacgacagtatggctgccagcttcgccctctccatgtgtggcagtgaccgactatttcgttcaaatgttcttaactacttatctaaaggtaggggcaaggaggggaaaaggggcttggggtcaagctataatcacgtttctcatctttaaaactgttaagtaaactagtggatcaaagaaatgggaacgccttctttccaaagttttttcagcattttaatgttgcctttagacagctaaatgcaaggtggatgtctggacacttccttagagtaacagaacacgttgatttgaactgaacaattcaagcctgtaggcagttttgtaaaaggaatatagcatagtgattacctatatctcacggagtttttaaaaagtttttcttaaaaacagctttattaaaattcagactatatagttgactcatttaaagtatactttttaatgttttacagtatattcacatagttgtgcaatcatcaccagaatcaattttagaacatttttatcatcccaaaaagaaaccctatacccattagcagtcgcccgccccctccgcaccccaacatgctcccagctctaggcaacactaatctactttctgcccctagagctttgccgtattctagacattcatataaatggactaataaaatacgtggtttctatgactagcttctttcacgtagcacaatgtttttaaggttaatccatgttgtagcatgttacgaatgccacatcctttttgtggccaaaattggattgggttttgaaagtattcaatgagtatgtccttataaagtgtttagcagagtttctggcccgcagcgactgctcattacagttgctacttccttcaacgtgaaatcactgcagtgtcacatacagcagtaatcgctttcccaaatatttactgttatgcagatgcaagttattaagattcatatttaaacccaatagctcattttaactattttgggtaaaatattttatcttccatccaaagaatgagtatactagtatttcctctagtaatactgtaaaaagaggaattcatacttctaatatactttatcacagtcaattgtagaaagaatagactcttgtaactgggagggacctcaggaacttagctaattcatccttccacttcagacacaacccactggtaattcttggcaaacaagaattgattcctattagatcccctgaaaaggtgattctataaccatcctcaatgacctattccagtgtctacaactcccgttctcagaaaattggttttatttatagtcactctccgcagcctattgagatagctgctgttggcttgcattatgatattctatgaaacatgtgctctgccctcaagtaccactgttaaatttctctgtcagtcttcttttttggtgcataagtgtttttaaatctttccacataggtcttgttttccaaatagctcaatcatttctgtggcttctctctgctgagcctctctgtattctctataccctcctccaggtaagcacctcagaggaactgtgcagtctcctttcctaggatccttaaggagaagtcatttacctgatgacatggccaacctcaagattcccagagctgtcaatataaacttcatcccggtgaaatctgactcgagttgaagagaacactggctttgtgcatcaggggccttcactctgctatcacttgctcaccctggacttttctgctctttgtgccatcactttctcaatgattttatttccttcccaggtctgtgatactgtacttttcatcactgagcttttagccacttattcctggtttcatctacaatggacaaatactacagccattcagaatccttattcttcccggaggccttcagctccatcggaaggtctggcgaatgtgatgagcacacacgctgctgacctcattctccaagcctcagatggaaatgtggaccaggacttcccaggggaagccgcctgcacaaaacatagattccagacctacacattctcgctttctgaatggaatatgccaggaaggaaggatctaaatatattcacaagtcagaatagttctatttaacatgacgatgcttgtcaaacattttgtcagaaagatttttttaaaagatactatattactacccaggactctgttcttgtcccaatatttgaaaactgaaatgagtccctccaggttagcattaccagatttagtaaacagaaagagaggatgccccattaaattctgtttcagatgaacaatgagtaatttttttaatgttagtatgttccgtgcagtgctatactttggccatctcaaattcaaattgaatggggcatcttgtattttatctggcaatccttatctggttcagaggcacagaggctctcagtttccttcctttaagaacatacatattggctgggtgcggtggctcatgtctgtaatcccagcactttgggaggccgagggaggcagatcacttgaggtcaggagtttgagaacaggttggccaacttggtgaaaccccatctctactaaaaatacaaaaaaaaaattagccaggtgtggtggtgggtgcctgtaatcccagctacttgggaggctgaggcagaagaatcacttgaacctgggaggcaaaggttgcagtgagccgagatcacaccactgcactcaagcctgggtgacagagcgagactctgtctcaaataaaaaataaataaataaaaataaaaataattctaaaaaaagaacatacatattaatttacttactcagacattaattaaatatttaaatagccactatgtgccaaaaacccttctagttgttaggagatagagcagagaaagaacaaatcagaggaaaattcctgctcgcaaagcgcttctacgaaatacaaaggtctggcaaagaggcactttgccatttcgaatttaccagcctcagttccccacatataagtggggctatgtagaagaaagaacatgggatttggaagcagaagatggccttgtctgtgagagctcaggcttgtcacttaatctctcagacagtttcctcgccaatgaaacggacaccacatctgcctgacttcacagatggggtgaggatcacatggaattttgtcagggaaagtgttctgtacgctacaaaatgttaaaatgttactaacattattgttaatgcaattgctttggtattttggaaatcaaatctttgggatctacaaatttcatataattgtggaagttacataggaaactagacatgtatcccaaaattacatggaaaagcaacttaaatttttttatgctaggtaatattcacaaacattaagtataggctgcattttctttatatactactgcaaaaatattttgtaaagtaggtaacaacattataaacattcagtagcaggattatcaaacagagccgtaagtaacatatttatatacttgtttgatgatgttgctaaagtttgccagaaatacccattgcaaacctttctataaagaaacatagagttgattgttttatgaatttttaaagaaagtctttttaaaaatagaaaggagaagtgaggccttaattatgactttccacattttctccttggcttctttgttaaatatgcaaaagggtaaaataagatcaaatgaggacacgataaagctgaatgttcgacaccatttaaaagcagttggtgagacattaagtcagaagttggtatacttttcaatatgctgttacaattttaggggaaattatcattattaaactagttcatagccaattcctaaattcacttggtctcaattgctttctccatgagtacggttagatttggtacaccatgaccatagtagtttggtgtgctagaaagtgggtccttaggccgggagtggtggctcacgcctgtaatcccagcactttgggaggctgagacgggcggatcacctgaggtcgggagtttgagaccagccgggccaacatggcaaaacctcatctgtactaaaaatacaaaaattagctgggtgtggtggcacatgcctgtaataccagctactcgggaggctgagacaggagaatcacttgaacctgggaggtggagggtgcggtgagccgagatcatgccactgcactccagcctgggcaacaagagtgaaattccatctcaaaaataaatacataaataaataatattaaaaagtgggtccttaaggaagtgagtaattcacggttagtccttcactaaattcatctgtaattttgcttattttcagtaagaccacacggaaactattctcattcttgttctacatacttttttggctgaactgtcaagccgacttttatattctggaataagctggggacagaacttcttgttttgaagggaatagctattatagccaaatgctaggatctgagtgacagactagtgccatatttggcactggccatgcctgagttccagcagctctgagcgagcaaacgacacagaccattttcttacaccttacatggtttggtgggaaggggcaacacggccctttgctatcaaggttaacagggaaaggaaagggagaagatcatctcataatgtatccctcaatccatattgggcacatctctgggagagtcaggaccagagacaaaagtctcctgacctagtatcttagaattacacttcagcactttcattttgcaagtgaaaaaatgcatccaggtggatttgcccaaagtggctgctggcaactgagacagaacaaagaccttgctctcttgacctccatcggggctttcccaccacactatcctgctcaccaatagtaggaagcacgtgctgagcctattagcaggctaatgagagtcagccattaacaatccagcaaagacattttcaggactgggttccacattctttgcaccctacggaaggtgctctggggaaaaaaacctattaattaaacgatgtgaaaacaatcctaggacttagctgttacttttttctaaataacaaaatatttttggcaagtaaacaatgtagttcatacttcagtggaaggaacatagccggggtacggggcaggccaagttacacacatacaagtaaacaagcggtcaactatttttaaatgtacctaccctgtccaatgattaggtgacccaaattctgatcttctcagaggatggaaataggttatttttattttgcaacccactgtttccttctatatataatactgcatttttgaacaaaattatatgaagtttattctcatttaaagttctgtgggagctgaatgatatgatacacagccttctacaattccttcggtccaagggtcttgagagggcctatcattttataatgtgtaggcattttccaggcctacagcactctatttttgtttcattcttttttttgaaactttttatgaaataattctaacacatggaagagtacaagagtaacatatcagacttcatattcccaccattggctctatcaaaatctaatatcttttgccatacttgccttcagattttttttttaataaaatattacagatatagttgaaggctattggacactcctgtatgatatcgcttattctcttccctacttcttctcctgagatgaccattatcctgaatttggcatttggcattcccatgcattttgcaattttgtttgtttttttgagacagagtctcgctcagtcacccaggctggagtgcagtggcacaatatcggcttactgcaacctctgcttcccaggttcaagtgacaatcctgccctagcccactgagtatctgggactacaggcatgcaccaccacacctggctaatttttgtgtttttagtagggactgggttttgccatgttggccaggctggtctcaaactcctggcctcaagtgatccacccacctccgcctcccagagttctgggattacgggcatgagccaccatgcccggattccatgcatgtttttggactctaactgcatatatatgaatccacacttagtgttcttttgcatgttttcaaactttaaataaatgacatatttaaatatttggtcattccactcaacaaaatgtttctaagattaggcaaagcgatccacataactctatttattttaacccattattatgtgctattgtatttgtgtagcacaatttattttcccagtctcccactggtgcccatgtatggcttttcccattttaaacaatgttgcaataaacatctttgcacagtaagtccttatttaaggtggataacttcttagaaattgtaactttaagcaaaacaacagataaggcaaacaatttttccatcaaatttacaacaaaacatggttattcgaggacttgctgtaatgtacatggttttgtttaaagtctgcttccaagcacctatcaacgactttaagagaggatttactgtacataaccccttatgcacacatccaagagtgtctctaagaaactgcttagaaatggatttcagagttgaagggtatccacagcttcaagagtttattttgctaaactgttctccaaagtgattacaccaatttacacagtgtatgacagctcccactgctgtccaatcctacaaaaatctgatatggttggacattttcgccaatatgaagaacataaagtggtatctcattgatattttaatggccatttccacaattacaagtaagaagaacacctatttattggccaatcaggtttcctcatctgtaaactaccaacttgtatcttttaccaatttttctgttatttgtctttttcttaaagacttgtcagttatatatgtcacattctatcctgtcttttcagtttatgatttcttttttgaacagaagtttaaaattttagtgtggtcacatttttaaatattttctattatggctgggtatggtggttcatacccagccataatagaggccaaggcaggaggatcacttgagcccaggagtttgagaccagcctaggtaaaacagcgagacctcatcactgcaaataataaaaatagaattagttgggcatggtaagggcaggcctacaatcccagctactcaggaggctgaggcaggagaactgcttgaggccgagaggtcagggctgcagtaagccatgatcacactactgcactccagcctgggcaacatagtgagaccctgtctcaagaaaaatttctattatgttttgtgactttttatttctttttaaaggaattcttcctaccccaatattatatagacagcctcttattttctcttctaaaagttaaaaaaaattgcttttctagtgcagatctttatctagaacttatttctgtgtatactgcagggtaagattctctacacagacaacccattatccaagaaacatttattgaatatttaaccctttcttcactggtttataatccctccatgatcaaatatcaagtttcggatttatataggtttatttctgggccctctactctgttttgctgttctatttatcagcttctaaggcaatacaatgctgttttcatttactctaaatccataacaagtcttaatatctggtagagaagattacttccttcttcaaaattgccatagataatcctaggctattgctctaccacacaaattttagaatcagcttgtcaagttccagggaaagtccagttgggattttgaatggaactgaataaaatttataaattagttgaggattttaactgctctaatgggcttctggacaataaatatctgggctggagcttccagagagccgaacacatggagactcctgaggggtggctgctcagggaaggcatggaagctccatgcccctttccccataccttgtcctacatatctcttcaattaaaaaaaaaaaaaaaaaatatatatatatatatatatatatatatatatatatatatatatatatatataatgatgtaataaatatctggtggctgaaagatcaactaaaaatgtcttacttttcaaagcaacaattaccttataaactgccatgcctcccatttatggacttacaaattctatcactaaacattctttataaaaactgagatcaggtgccatggttcacacctataatcctgtaactaggcagcttaacttcaaagtgcatttaaaacatttttcccctttctcttgggtttaaaaatgtaaccttgaagcaaactgcagaagtgttttcccttagtcttaaaatagactccacgacccacccctttctcactgtctatactcccttcacatttatctaactgcatgctggtatctaattatctgcctacttagaagttccaggggctaaacgtgaatcttgagtcagacagaccaagcttggagacccagctgcaaaattccagagataacctcaaggtggctagtcaacaacccagccatcgttgagacgatgccagcctgctttccacctggactgggacccaagacagctaccagaacaagaaatacagacactgtactcagcataatttttacatgccttccatatcatgttttctctttttaaaaccttgccttgcccctaaaattcaaagtagttgcgttggatgggaatctggccactttcctattattacttttggctaataaagtaactttctttttaccagacctgcctcttgttaactggactctgcgtgtggtgagcaatccaacttgtgttcatttacaatcccagcacttagaggctgaggcaggaagatcacttgagcctaagattttgagaccagcctgggcaacacagcaagaccctgtttcttcaaaaaataaaaaacttagctgggcgaggtggcacgtgtctatagtcccagctacttagaaggctgaggtgggagaattgcttgagcctaggaatttgaggctgcagtaagccatgatcacaccactgcactctagcctgggcaacagagcgagaccctctctctgaatttaaaaaataaataaaatttattttttatttagaaaaatatttatttttttatttattataaatttattatttattttttatttattagaaaaaagaaccaaaaaaatctggaactctctgaatgcttatttccactctaggtatctatcagaagataagaatcttaaatattaaaaaaattagctggatgcataaaatgcacattgtagcattacttagagtaggaaaaaatgaaagtaacctaaatatcaatgacataggactattaaactagaagaaatatacccaatgatacactatgatggtgagaaatatactggctctaaaaactatttatagcaataatgaaaatggttacttatggtatagcattaagtaataaaattaggatatcagttgttggtacactgtgaatacagctgtagaaaaaactctggaatgtgtgcactgaaaaataaaatgtactaaactatttacaatagttaggctgggaatacagaattacaaatagaattctcccacctactccacctgttaaaaaaatctattgtagggccaggcacagtggctcatgcctgtaatcccagctctttgggaggccgaggagggcggatcacgaggtcaggagatcaagaccaccctggctaacacggtgaaaatcgcttttactaaaaataaaaaaaaaattagccaggagtggtggcacacacctgcagtcccagctactcaggaggttgagggaggagaatcgctttaacctgggaggcagaggttgcagtgagccgagatcgcaccactgcactccagcctgggcaacagagtgagactccatctcaaaacaaaaaacaaaaaacaaaaaaaccactattgtctaaaggggttacttttctatcataacaaaatacattgtaaaaaaataataatattaataatgtgagtagtacccgactgtgtcttcagggcgtcatttaaagttcgaagagacagtgcttgtaggaagcaaagcattcaaggccgacactcagggtttgggatctagctcaatcactgattgttttagaagttttgggaaagagtatcatgcattttctccgtgaaaaaataaaaatatttagatgtatggattagtcagcaaacctttatgaatgggcattcattaagataactctgaaatttcatctaaatcatgcaaaacacaaagactgcctatttcattttctttcaagtatgaaggagagtaaagagcagggagtttgccatttggaactggaaaaaaaattgcctacaacattgtttccagagcttgtactttttaccttaaaaacatgaaaggcttcaaactggatgttgggacttttatcccgaaggaggttcatcatgagtttcaggttctccggcttgctgatatactttgtcatgatggcaaagttgtgacggtccaggatcagctcccctagcagctagaggaaaacacaaaaccaaagctgtaatctcagagccacctgattcaaaatatagctcacgtcttctcactgaaaaacaaaatataaatgtgagtaagaatggtgttgtgaaaaaaattagagtgtccttaagtgcatctcaaagcacaggcataaaagcaatagttattgagcaattttttcacactgctttgctgatgtcagtgcttagtacctttttttagttggtctttgctgcagctcacctagagctaggcagaaataaatttatggttttcaatactcactttaattatcttgcttcgcactaatgtattgctccataggcattcaggtagaagtaataacaaaattggtaccataatgataccttctttacctgcataaatgtatgctaggagttcactattaagacagtttgttaaatgactcttacatttcccctgacttttattataaaacctgatataaagtcagaaaaaaaattgaccccaaatctgtatcaaatttagtaagtgcagcaagtttgtattaaaaagcaaagcaaaacattttttggtgacaaattgatagttccccaaatacagcattaccctaaaacaaaataaaaatacccaaagtaagaatagttgaagaccctctagcaacatggctgaatgtattgttgctctatcttagaaactttttgttctcaccataattctggagaacagaattatagccccctggctgctgtagcaattcctaaagcttcagcagccagggggctgaaacatactgtaatataactttatatagaagatatgtttagttttcaattgtcctatttactggactttttctgaaggcctcaggggagtaacacatcattacatggttacagaaatcctggatgggaagaaaagcgcacatcaaactgagggccaactgtctatcaaaggagtcccagatgtgtgcaagcatctggctgccagtaaaccaccaccttgcctgtgatgtatcttttgtgtatttaacatgaaagaagtatacaacctgaggttattttaatgcatgaaaataacgtttgtcaaacctgaaaaaaggatgacccctgttggatgttggctggtcactagttattctcatacacatggaatagcaaccacgtagtcaaactgttaatctgcaacctccttcatctttctgcagcttctaacgttaacctaacaccttctggaaactttctttgctcctggtttcctaccttgtgcagcttgttcccttgctacctcttcaatggctcccttgccttttgcactacttatgcagcaattttccaagctgtatacttggatctgctatcttttatctcccaacagtctcatctatacccatgggttcaactgtaacatctaggaagatgtctcccaaatctacatttctagtctccgcttctttcctaaactctagacccacatttctttctttctttctttttttttttttttttttttgagacagagtgtcactctgtcgcccaggctggagtgcagtggcgcgatctcggctcactgcaagctccacctcccaggttcatgccattctcccgcctcagcctcccgagtagctgagactacagccacctgccaccatgcccggctaattttttagtatttttagtagagacggggtttcaccatgttagccaggatggtctcgatctcctgacctggtgatccatccgcctcggcctctcaaaatgctgggattacaggtgtgagccaccacacccggcctctagacccacatttctaactgcccactgggcagtcgcacttgaacactgctggactgtcacacttagcgtctctaaaaccaactccctttcttctctttgttaatggcaccaggagctgccctcctccggttgggaagagaattggtcttccttagctcctttctttcccttgctcctcacatcaaatctccatctaagacctaccaattttctgtttttaagtgtttcttgaacacctttcattcaatgttcacagccagtaatctcattcaaaccctcactacctttcagctgacctactaccacagcatgcaaaatggtctctccttcagtcctcacctaatccgatccattctgcacattttgtcaaagaaatcttccaaaaatcagtatttgttaccaattccacttagattagaaagtgaacgaataaacaagcaaattcctagattcccatagatttagaaaaaagtaactcattaagatgccgttcccagcctctgtgatgtggaatcatttctcctgcttcctttcctcagctcccttcctccatcttccccactctcctgtctctgtggctttacttccccagctccaaaatcttgagaaacactttcacctcttctctgcctgttcaaacctggcccatcctctcagaaccagctcagacatcgtcttcgggaaagcctttcctcttctctacagttgactttgctttgccttgtagtgcagagttatttgtgaccctgtttaaagaataagctccataagggcgtgtttcaaatccccttacaacctaactgtgtgatgtgcatgggtattgttggggaaataaaagtcctacccacatatccagagcacaatacagtaactcatctctgaaaaagagattgcaaacagacaaaactatcccttattacagtcaagaagctacaatccattacatatatatatcctcaagatgaagggtaacctgtccactgggggaggacctgactaccatttctgtgcactctttcatggttccccctaatgcacctagcaattaaggtgaccatttgttttagctatttatctgaataataaaacttctcttatctctctgacaagcaaatagttggaaaagggcacctaggttaaactctccttgtgacagagagatagtattatcttcctagatgcttatatttcaaaggtagggcttccagaccctccaaaaagaaaaaacaaaaactaaaaaacttctgggttgtaagcctgtccagagccttacttatcttctaaagatatatacaaaaataatcaaatactgaatagacacatatatatcatatacactcatgttaaaaggcttcagcaaaaggaaaatttcatttttgaaaatttacacacacacactcaataaacatttgttgaagttatatttatgagttaagttcagattaggtcacttcaatttttattacctggggatacctacatataaattctatccaatctatcctctgctaatagaatttcacaatttttctgaaacaattaattgtgttaattcaacactaaatcttttagccattaaatgttaatctattttaatattaacaatgacaaaatgctgcattccagaataatacaaagcactataaagcaatactataccaagtaaatgggaaacacacatattttacttctttaaatttcttattttgtatgcctcatagtacatagttaagccatgcagcaagtggaaataagttttttagaaacctaagtgttttaatgaaattgaccagagcccaaaaaattccccagtttccaccaagcttcttttgaattataatctttcttgctggtaattaaatgccaggcctctgcagaagataaggaaaaaattccaaagctctgtcacatgatggaaaggaatttctctgttaattattttttattgacaccaggaattaagcagtgcaggaaaatttagaatatgattaataaaaggcagcaggtagcaactactttggaatcagaaaatagcctagtacttaagacagtttattacttacaaagttgctatataataatctaacctctcttgtttcctgcaattatgaaacatctatgtaaaaagtattacagaatccatttatacagaaacacagttgtgtcaaaatagaatatactgctaccacagatctaattaccaaaaggaaaaaccaaaattgcatcagtggagcttccagaatgtttttctagcaaaaaaaaaaaaaaagagtaaacaatatttaatgagctctatgtttatatatgagcttatttcacagtcgtctacctttttgtttgcttgaacagagtgatgcaaaaccattttggcaacatctcttcctataatctaacattaaaaaaaaccaactctccagtaaccattttaatactttctgcattcttaggtaatttatctgcattttgtcaggcatttttttccagtgtcctatcaattcttggttttaccatgctataaatcagatatccatgagatgcctaactgtaaagattttaggaggaatagcagccaaatggtatgtctgggtgaattaatgaaaaacaggaaagatgcctcgtgaataggctaaggcatctgcaaataagtaggaaatacaaacagctttcttcctccaaatttggttcaatcaccttagttcacataaatctctcgattttgatccagtatctgatagactcccattgaaaaaaaggaaggatttggagaatttatgagcaacttcctatatgctggaccttcagagcactgtcacctctgtttactactccaattgccatcttccttccagggccactactcgttgtaccatggacaagcttacctcatttggctatccttgtggagccctacaaataacgagttctgttctttacgtatgcagctgtataaagagaatacaaccttatcttcatctgctcttagcaagctttctggacatgggagaacacagcgctgaagtcactctctgcccaaaggtcagttccacacacagtttggtctcatcactactgggctttttttctagatgggtctcctggtataagtttctacacaaaggggaaactcaataaaaagtgctggatggctggctgaaaaatggcctccccattaacacccagtgagggtacaaatataaaggaaaccaggtcatggctgatgcaggatcgtgggcaaagtaaattgacaaaaaatgtgatacaaaacagattgactttattgtcttagtttaaaattatactccaaatttagaagcaaatgcattgttctatgaatgccatcatcttgacatgtaaaaataacacaagtgtgtgacactatatcccaaacctagaaaaaataggaaaaaatgacaatacaagtgtgatgtttagcaagctggaccatcatatgagttgctgcactaaaaacagtcagttttatcatctgctgaaaacattctttttgtgggattctgagagggatctgaaggacagagacacaactccagcccacatctccctcccctcaggggctctcccacctccccctggccacatggctgcttccaggcaccattccactgtgggagagagggccacttatagatggatgtggtcttactctgttgggttccctgtcatttccacagccagttaataggtgcataacctcaagtagcagatgtaacttggtttcacacaacacacacatacacacaaaaacacccttatcagagccatcttaattttccataaatttagccctctgtttaaagatcaactcatcaaggacttcactgatcgtctagctgctctggcgcacacacacacacacacacacacacacacacacacacacgcctatctcccaagtcgccgctttctgtctcctttccctactcttctttttagtacttaaaaccatctgaaaactatgtatttatttgtttatttgtctattgtctgttttccaacaacagaatgtgaggcccagagctgttcttggctgtcatcatatgtctggagaatgagcacataaatatttgttaactaaatggaatgtcttattacctccctcacacctccttctccaataattcatcaaactatgctatttacgggtaattgagaattggctttattttcatttccagctagctgcatcgtcttttaatctcttgccagattctgtttcagtgtaatcctggcagtattttagaaaagcaaaatttcggtatatacccaaaggactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatggtgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggagggggtagggatagcattgggagatatacctaatgctagatgacgagttagtgggtgcagtgcaacagcatggcacgtgtatacatatgtaactaacctgcacaatgtgcacatgtaccctaaaacttaaagtataataataaaagaaaaaaaaactgtaaaaaagaaaagcaaaatttcgtatatgcgatcatgtagtcttctgacatatctgtttgttagaggtgatttttaaaaaacatttctcttctaattcttagggaatgaccatgtttcatatttcagaatctctcccgtaaatatcatgtgaacatgtcatgttaagtggtggaagtattttaagcaacctgcaggaaaacactgactgtcgtgaatgctcagggaatgggacctggtgatgaaatatagcataaaaaattctttaggaaaatatgttacaaatctgggagataaatgcttcccataaaacagaagccccataacatttcaactatataaacataatttgatagtaaaaagctattttatactcaaaaatacagatattaagaatttatcaattgctgtgcttaaaacttagagggaaggtttaatttttgcattttacatgtcttttttttttttttttttttttttgagatggagttccgctcttgttgcccaggctggagtacattggcacgatcttggctcactgcaacctccacctcccaggttcaagcgattctcctgcctcagcctcccgagtagctgagattacaggagcccaccaccacgcccagctaatttttgtatttttagtagagatggggttttgccatgttggccaggctggtctcgaactcctgacctcaggtgatccgcccacttcggcctcccaaagtgctgggattacaggcgtaagccaagatgcctggcctcagcagaaatattctaaattttacttatcatgtacttatattgttacttccaaaagcaggacaggacacttacattattttgctataaaatacagtcataacataaaatatagtaaatacttctcaagttatttaaaaaaaggatattttaatttttctgtgtttactcatatactaatagacccgtcatttgctaatgagatataaacttacggggacactgacttaaagaaatttgatattacctttaaagactgtctcttagtaacataattctcagactgaagcaatttctcatagtcttcaaaaatctaatgaaaagaaaatacacattagagtgtaaaagcagcagtggattctccgtattaggctggcttgctttctttttcaggagcaaattcccaacttctggccattttaccatccttctttacatgtgaagacactgggggacagggaggtcaagaattacaagagacatccttccctattttattttagttctgcaaattagataaaaactgagtaattttgagtccttccaataaatcattttgaataaaacttctagtaaaagttgcaagagaactcattttatgccattttaaagaaatctttatgtaagtagccttgctggtggctatgggtccacaatttgggaaaatattaaatacacttaaggcttcacttggcaagccataaagaatcagactgttcaattcactgcataaacagataaagaacgaggcaacctttgttgcatgacggcccaactagtctctctggagcacttcactctcaccggaagctggggacactggtgcacgaagtcttctttcctaacatggtcaccaaccatggcctagcccttcagtttaacacagagtgctggcatctggggaggttcagcattcacttccatcaggtgtgggcacacagctcatagagcactgaagtgggaggaatgagcgcagccaggacggaggacaagagatcaggaactgaagagggtgacaaactcctagccctcggagagtcaagtgcgaggggagagtgtgtgccgctgtgtaatgagggcaagctgtgcatgctgacaatcaccgatagagaataaagtgaaaagtaaaaatacaaaggtgtagctcacattaaaatcacagtaattatactctttaatatgaatgacttatttattctatcctgaaacacaaggagaattttgtggatcattaaatgcatcagacaagccttgtgataaatttgaatagtaaatataaaatgcaaatacatgtatgtggtatgacctactcccgagtccaccagctttattactttagagtcatgcatcatgtgctccagtttcatggcatactgctaaagaaatatcagctgaaagagtctgaaaggtttgaaggggcatgagttctcagagctcgcattcaggccaatgcaggagcttcagcagctgtgaaattactaaattacacaagaagtgatatatggatgtaaaaacaaaattaggtaaaaaaggagtcaaagagaatgaatttattagtctctcaaactgtcatgtattatacctgaacacaaagcattactgcacaacacatttacctcattcattctataggaaaaaatagtaattagttgatattgtagatttatccacgttatcttagccttttaaaaattttatttcttataaatgtgacatctaatgaatctttccttaacattccatctagcatatatagttactgaacaaccaaactatatattaacagttcatttcctaaattcaaaaatagacaattttctttttctttttctttttttttttgagaccaagtctcgctctgatgccaaggctggagtgctgtgacgtgatctcagctcactgcaacctccgcctcccgggttcaagcaattctctgcctcagcctcccgagtagatgggattacaggcacccgccaccacatctggctaatttttgtatttttattagagacaaggtttcaccattttggccaggttggtcttgaactcctgacctcgtgatccacccacctctttcagtctatacattttgggatgcctctagcaataaaaattattctccttgcagtagaatgaggttattagaggctggggaaggtaggagggagggaagatgaagagagactggttaacaggtataaaaatacagttagaagaaataagttctagtattcaacagcacagtagggtgactatagttaataatttactgtatatttcaaaatagctagaagagaagatttggaaagttcccaacacaaagaaacgataaatatttgaggtgacgggcatcctgattaccctgatgtgatcgttacaaattgtatgcatatatcaacatatctgatgtaccccataaacatgtataattattttgtatcaatttaaaaaatcatcctcccctcacattttacacttaaaacaaatactctagttgattctgtggctatttcctttataacatgaggacataaaaatcacttttgattttataattatattgctaattcctaatcttaaattgaaggacaactggcaaaaataaaatttattttatttataattaaaagagaagtagttaaatatttgtgatttgaatgtgtgaagatatactattgataggcagagtaggccacaccttcccagtattcaggagtatgttgcaacctttgtctaggatataaatgattcagagactccttgaggactattattaatatttgtttgctaccactggtccatatgcctattatgtgcccaactatactgcatactgttgggaaggcataaagtcatagtaatcatcaaaaatgtacttctttttgtaagcacatgtaatttaatttaatactaaagatttcaatcaataaagatactttaccttaatttacttattactaccataaatatcatatacacatgaaattgttttttgcttttaatagatgaagacaaaaaaaatccattcatcataccatatatataaatatttagaacttcttggtttaggcatcaataatacaaatagttaagtgctgctttaagacagcagattacattcttgctgttaggtgtcaggcactagactgggtgatggagacagagtagtaacattaactaacacatgtaaaaatgccaaaaatcccagtaaaaaataactgtggctgttgctaggatgaggatcagagactccccttccctaagtcctagtttagatgcatgctgtccaacatagggccatacgcggctactgagcacttgaaatgtggctagtccaaactgagatgtgctgtaagtgtaaaatacacatcagatctcaaacactcagcatgaaaaaaggatgtaaaatagcttgatcatttttcacttcatcttagccaaaagaccgagaagcgatgatcattttccatattgattgtacattaaaataacatttttcgtatgttgggttaaatagatgtatattattaaaattaatttcacctgtttctttttacctctttgtgtggctaactagaaaattttaagttacatagtggctctcatttctggctggcattatatttctactggacagcactgaggtagagcatctgaaccaacactagaacaaaacatacaaagttttccttctaggtttgagctatattttactgtataatgctgcttctattgcttacacatttagtaaaagtatcgttgcttttggatggatctgtcaccaccaaatgtatgacactgcattaggcattaggaaaacaagtaacaacgattaaaaactaatactgagtgcttactctggtactgtgctgaaaactttaaatcccgtcaaactccctcaacaaccctatgattcaggtattattactatgttcattttgcagtgggtgtagtaacttgcccagggccactaaggaggcaggtcttgaagccaagcaagcacgaagactctaaagtccatactgtgctcttaaccctgtgtcctgcagataagattcctgcctcttagggggtgcaagggccagccagaaagatacagacacaccataataatacaaggtgaaaaataagagggagccagagagagagagaagaaagagagaaggggagaggagggagaggagggagaagagagaggagagaggagaggggagagagacagagacagaaagagagagagaaagagaaaggatgcatgttttgggaggggtaggattagggaaagctttctaaagagtcatatttcaaccaaatctcaaaaggatgagttggattcactgtcagggaagggagttgcaagataaaaaatatttctggtatttttactactaagtaagactaattatcaaccaagtaaaatgatgtactttagtgagggtggggttctcttccttttggagttacctactgcctcctttgatttgcaacatcaaagcaagcaggtgctagtcatttattgagcttcagagcacaacacgaagagatgtgaaaaaggtgaaagccctgacctcctgccatctcaattttccataaagtttcctgatgacctggtttccaggtagacaaatcaggagtatggttgaatgcgactgatttctcttgtggataattcacaggggcaattgctcatagatctaaaagggagggagagagaaagtgggaaagtctttaaaaatgatttctacttacagtgtcgtaattttgttctaagaagtctgctaccaacactttatgtctggttagtaaatcctagaaaaagaaaaaccaagtgaaacaaaactgttatagctattaatattacaaatgtgtcttttctaaggtttaagaacatataaaagttgcagaagaacattttcatttgcgccacaaaattatttccattcctagcttagcctaagatgtgaaatacaagtttgtttcatgttagaaaagaaaaactctggtgttaaacctagtgtttcaaattcatattgttagatttatgatagaaataatttaactggtgaaacaaatggaacttgagatgagttaattttttttttttttttttgagatggagtctcactatgtcacccaggctggagtgcagtggcatgatctcagctcactgcaagctctgcctcccgggttcaagcgattctcctgcctcagcctcctgagtagctgggactacaggcgcccgccaccacatccggctttttgtttttgtatttttagcagagacgggtttcaccgtgttagccaggatggtctcgatctcctgactttgtgatccacccgcctcggcctcccaaagtgccttaaccacttttaaaatgggcgcctcggatactggaagcataggactgacatttagcagtgtcaaaccagtattgttcctgctcttgggttaatgggatgtaaggtgttgtgcaagttactaagtagcacaatccatcctttcaaaattgaagatgagtagccctatcttatggcagatataaacttgcagaaaactgaacaaagcatgaagaaacatttgactgtcttcaactcatacctaaattatatccttaactcactttaatgttgtaggaaaacaagcctcacttaatcccttttatatgcttagaggctaaatgccctgtctaggtgctatgaaaaatttaattaaaaacataacaagaattttaaagttttccaaaataaattcttttaatacatatttaattaaaatttcctaaaagcatatagaaggtacacaacataacttcacaaagaaaaggcagataacaaccataataaaacccacttatttctactttaattttttaaaaagtaaaatatttaaagcattgtgtactataattttcaaattcaaaaataataagagtggctcttaattccctattgctatcacacaacttgatcaaccactgggcctatcagtggaaacatggtgtttttcccccccagtggagcagagcattcattaccactctggaactgaagttctaaaatggaaaaccatttacaggggttccgttcccaccccgtcaaaggtcttgattcaaactagttcctgcatcaggggacccttgaaagagtaaggtagttccacaagatcctttgaggtccctactcttttttttaaaggataatattggtgtcatgctttcaagcatccctcccctaacatcatagaaaccccatgagcagtaatagaaattttctgagctgaaccagggcagagggacccccctctatgggctgcagcagacactgtggattgctgcacccatgggagttctctacctgcttcaactatcgtcagcctttgaaagtgaggactgggttccccacactgcaggcccagcgcacacagccccagtggcaacaaaaagagcaggttgcagatcagtgctgccttgaaaggttgtgtcatacattagtgttaccccaaagaaaaagggatcaggagggagttaggttaaaaccaacactttcaaattccaaggcaagaaaaccttgaaacagcttgaaaatccagtattaggaaaccataatagggtggggtagaattcctccagcatatatatatatgctagatatatatataatatatatatatatatatatatatatatatatatatatcatatcatggatacagccaataaacaatgcacacattccctctctcacgcccacatttccactccagtgtgtaatgggattgatacatggatataccctcaaatttatgtacataataaatgtatatacaaaccacatatacatacacacaggcttatgtacacataatacatagacaaatataattgctgcattatagatcacataactgagtgaaaaaaaaaaaaagaaaccacaaaaaaaacagctaggatcctacccaagaaggaaaagacagaaaattgtgaaggaaaataaagttcaaactccaaagaatttagaatttaaaaaccttaattcaaatagtgtactctttcatcctacctcctaacaattctgttttgagaggcctaagttttgcatagtatattatgctgaaaaatctgatatctatatttttaatgaatactgcttgagagaaacttggggtagagtgagagagacacttaattgcagggacataaaaggctgaggagccagcgacagctgccgtttagagggctgactgtgctggggagtgtaccgagcactttgcaaatacggtttctgatcttcacaagtccgtgaaaaagggatgattttcttcatttcagatgtggaaaataaaactcaaaggttaactaaattgctcaaggacatccagcttatcaggtggcagagaaagacagaattcaaaccacttctattatgggaatttttagagggagggatgaaagagattatggttgtatggaatcctttttgggaaaagacttttggtagacaaatctatgccaaaataaaaaactaacaatgttacaatattaataactaaactgagcaacagtccctttaagagctcaaaaccaaaaagattaggaggttataaaaaacccaaaaccaatgccaaaatcaagtcaatcatccaaccaaacaaaaccctttgaaaccagctactttaaaaaaaaaagtgatttatggtcattgttacattatattaaccataagcatttggtaaaataaagaaaattggtgtttccaaaactgacagcatactagaaaactttttatgattatttagattttaaaggattgacttaaattcaatggaaaattggcttaaatacaaatcaaaacaccatttatttttgtcattcaatattgttgctgaaaattaaattgggctgaatatatgacagcaagaaattactatcaagtacatcttattctatcaaatgtttaaaaacctttggggaaattttcagaaatacatattaagtatttgctttcctcctctattggcgtttgttctatgtttgtaattatgtgaaggcttacttttttttaaaaaatgaatttacttgtttccatgacagcgaagagccatctgataggaaaggggaaaaaaatgggactgtagtgtctattattagcaaacacctccttagtagtttagacacagacattttggtagaaagaaatggaatcatcctttgtatttaatgtcattcttcatgttggatgcaaccgaggcctatctcaccactagctctagatccaccttttgaggggatcatctctagccgctgtacaatttttgtcttccggggtgagaaacagccactcctgggatttccaacactcggagcccggagccatgctgccctcaccgcccctcccttcacccagcagtcacttccaggagtctgttcccaagcccttcctccttcttttccttccttccttccctcactcggctgttctcccgagatttcagtttccttactccaagcttcccattcttcatactccgcctctcgttaactccccttcttcccttccccttcttttccttgcccttttctgtctacccagacctcccctgtgggctcctcctctcttccctgttttcttcagggagaccataggacgctggcaggctgaatggaggcctgtggacacccgagcaggctgcaaactccttcccttcaaacccggacgctagaggccttgtgtttgttgcagttttgcctgaggctttggggaaatgatggcattgcggttcctttcctctgatgtctcgggcaattcagtgcttgtccgaaacccgcacaccctcctgcttacgacaacaaaagtgccacagtggccgggcgcagtgactcacacctgtaatcctggcactttgcaggggccaaggcaggcggatggcttgaggtcaggagttcgagaccagcctggccaacatggcaaaaccccctctctactaaaaatgcaaaaattagccgagcatggtggtatgcgcccgtggtcccagctacctgggaggctgaggtgggaggatcacctgagcctgggaggctgaggctgcaatgagctgagattgcaccactgcactccagcctaggtgagggagtgagaccttgtctcaaaaagtgctgcagttaactgggcttaccctgctcctaggcagctgttaacaaccagctgctgttgcttaagcctgccctggaatccacccccagcccaccccaagtggcttccaaatattcccatcattctcaaacagtattctccctccagagttcttgtcaattaaattttcctttgcatcctgtatttccagagatggcctggttgcctttatagatcgtgtgccaggcagctgccaggacttgcctcccgcttaaccacccaccactctttggtcttctccatcacaacaaatctctctgacggcccagcctgcaggctccgcctccagggagaccacgccccgtccctcaccctccgccaggcattcttctccctaagtcccagcttccttctgccccactgacatctcctaccctttaccactctctgacactctctcacactttgtgtcaccatgtgacctaatatacctttcaacagatttatggcaccttctcagaacaggctgggtaacttcctagtctgcagataataggtagttttcagcagagcaaaccactgctttcccctttttccacctctggagagctatttaaaagaactatttaccatctaagtcataggcaactttcaatcactgttcataaagtaatacgattggagtatgtattaatattagtatatggactatatcgatattattgaaatacatatttaaggtaatatataaaaaataaaaattcatacatggattacaattaagtaaaacttgtaaaaaaaagttacatacgtatatcctgaaaaaagtataaattaatttggagttatgtaaatagaacaattaaattgctaaaatgcttttgaagaaatgaatctgaatacatatatatatatatatatatatacatttaaatgagtcttacctactttttaaacctgaaaacctatttttttcaatgatgctgttacattgtcagtctatagtattttttgaattcctcttctcaaacagcttcagagctgatttggtagacattgaagaaaatcatatctattttatttctatttatatcttaaaattagttttcttataattattatccctccccaaataattctagctaacttgatcacccactttatacactaaccggaatgtcaaataggcttttgtttccaaaacttttatctgcccttgaatgataaaagtttgccattattgaaaaatgagcatgtaatacacattgataccaacttcaaaatatgttaaataatagcaggatcataagcctaagtaactggttttctaaaatagaaatctcgaatgtaacatcactcattagatgactaagttttggtatgtttgtctgcaaattagctgcactcttttctgatatattctctgaacatttttttgatgataaaatacagaaaccaaaagtaaaatgattgtcaggggctggagggaggaggaaatggggagttattatttaataagtatagaggtagagtttgaatttttcaaaataaaaaagttctggtagttggttgcctaacaatgtgaatatattgcatcctacgatttcctacatagtgacaaagtagataatacatgatcaaactatagatgattatgaaacaacgacaatataatttcttactattttgtttcaccatgtggacatttaaaaatttcattcataaaataacatgatgtccttcatattcaaagatgtaattctccatctcccttcactacctagttcctttccccagaattaatcactgttgctgtttcctatgcatccttgcagaggtattcagtgcatatgtaccttaagtggaagcttatgccctttaatctgtttttaacataaatgacagcatgccacacacagagcactacatattcctttcccacgtaactgtatatactggaattcactccatttgagcttgtgacaaatattttgagttgttttcctgcaataggacagactggcctcatagactgcattctatttacagattcctcttatgatccacatcatacatggttggctacactgaggcctaagaagtaaaatttcttgctttttaaaattaaattgcctcttcaggggccaagtgactataaattgacctagctgagttggaaaaaaaaaattaccttgaaagtagcaaaggcatctgaagcaatatcaaatgttgacaactccacgtacttaaagaaatctctgaattgattagaaaagaggatgattttggcaagtggttcatgtcgaatacattctctcagcataatcccacaacgtaaggcaatctgtggggcttcatatctaaagcgtaaacaagagagaaatagagaactctgttatcctattaaaataatattaatggcatcaaaagaaccatttcaatactgctattaatggaagcatacataccatttgtcacgattcattcaatatccactgaagatctactatgtgcctggcactattgcagacgtattctggaatttgagtgtattctgaaacacttagatatactcaaatatgaacatggtgacagctgggggtggggggatgaggcagaatgtaaacaatgaaaagataatttcatacactgagaagggctgtaaaaactgttgacaataaaatacgccacattataaaggtgactaaattgtgtgtgtgtgtgtgtgtgtgtgtgtgtgtgtgtgagtgactacttaagttactttactttagactcaaggaaaaggcaaaatgttccaggcaaagggaaaaaactgttcaaaggctccatggcaagaacaggcttggcgaaacagagaaggaggaataaagcctgtgtgattcgattgtagaggaagaaccgtgagtggtgtgaaatgaggcaggggtggagagaagggcaggggccagatcccagatcagatacagctttgtcagccaaggtaagcagttggttttattttaagtgtaatgggaagcctttggagagtttaaagcaagaaattgacaagactaacttatgctttaaaaagatcactctggcttcttgttgagaatgtctgtaaaacagcaggagacatataagaacaggagcagaacccaggagagggaacgggggcttggcctggggtggcaggagcagaacagaggactgtgggcaggtggtggatactgttcggaggaagagtcaacaagacttgctgatgatgtagctggagttgggtgagggaataaatttggaaactgagaattcacgaatgattcctatgtttttggcttgaatcactgggtagatggtggtgctatttattaagatgaataaactagtagaggaacaagttagtaaagaaattaagagtttgtggttgaccacattagttttgagatggctgatatctaagtagaaaggtctccttggcagtatgatacacttatctggactttaggaaaaagataggagagacctatataaatatatgatttgcatgcagtaggtggctaatacatagctgtggactgattgactcacttaaatcctaagtggaatcatggctcacagcaaaaaatatgctagacaaacgaaacgtctactgtgggaaacaattcaggactggcataccagattggttccatttctaatacaacaacaatctctcaaagtcaaattcagtctctaagtaagtttaagatatattccagtgtgtgataagatttcaagaaaatgaataatgcttagcccaagtacaacaagccctgtattgaaataatacagttgacaattgtgtggtaaatataggaagaatagaacaaagaaagatatagttgtgatacactgggaagtgagcagaatatagggccccctccaaaaaaaaaaatctggtggggcgtgactgctcactcctgtactcccagcactttgggaggctgaggtggatggactgcttatgctcaggagttcgagaccagcctgggcaacatggctgactttacaaaaaataaaaaaataaaaaatttagctgagaccctgactttacaaaaactaaaaaaattagctggacatggtggcacacgcctgtagtcccagctactcaggaggctgaggtgggagattgcttgaccctggaaagttaagcgagactctgtctccaaaaataaaaataaaataaaataaaatctgaccatatttttaaagagatatcattgaccatttcaactgaatactagtttttatggaacttttatgatactataaaactttaagatattttattactcatcaactactagtaacaacatttgttgaacaataagtaatgtactactctttataagattatagaattttcatgaaagacagattcaagaataaagattcaattgaggaaatagactactttccaatatcaaatttacaaatattagtagaagaaacagcaaacaaagataccagggtggtatttattcatttttgtcctgtttatgcagaatgatattcacaaatattgagtattccctgaataactcatagtaacattaaatgctgatacattcagatagtcatgattctttgtagaatataaggaatgccaatttatagtgctagcaatttctcttattagaaaaacctgaaactcagcctattggctcacaaggaacagttgtcaggtggggttttattaaagatgttgtaaagaggggtatatgttctgaaatgtaaaggagaaaagcactgtcatttattgatagagtactcaagagagtataaaataaaggctgttggcctagagaaagaatctaagggaaggacaattaaaatccagacttattgatcagcaagatatatgtggatttttgtaatttggccctaaccttaacttttcagtttcatctcccatcacattcgttatttccctggagcccctcattccctcaattggaatgcccttcttacattcccacaactcagatgcttctcatctctcaaggcttagttcaaatgccatctcctccttgaagcctttcctaatcactacaattcaggattattctttctgcccttcacactcaaataacagcttgtctgtaatttctctttaacacttttttcattctgtattatgttatactgcagtaaattgctataggtctattttcttcattacaatcaatttaattgttggggatatgttttacttatcctgttaccttctcctctcctcccctatccccatctccatttggtgtctatgtcatttattgctactttctcctgtccctaccccagtctccgaagagtgcctattataatgtttttcacgaagcatgcatataatgaatttaatgaacctcaaactgaagaaatgtcttaatactagagtactctaatgagagtcaaactctgacgtatacaaaatatgcatcatctctggccaacattttctcatttcttaattcaatttccaaactaagaccatctataaaaagtttccactctaacttttgggtataattagttctctttttcctttcatttcgtgaagcttattgaaaccatctgtgatgcactgacagtttattcttgagaatcaaaagaatgtttttaaaaaaccaagactcctctgggtcagcacacttgtcatttcatcccagcagtttgacatctgtcattctgagattacaacttcttaaattcagaaatacatagggatatacagagatatatagggaattctaattctcctcagtactctttaagtgatttataattcacatagatcatttctacctgactaccctctagtatattgacttttgataggttattgcttactatttaaagaagtgctccaaaagataagcttaggttaagtttcaaatcccactaacattaatatccttaggtctgttaaagaatcaatatgtatcccacctaatctattctactcatagataagcttcctgatggcaaggatcctgcctaattactgcattttccacaatggctaacccatggcaggtccccagtaaaggttaatctgatgaatgctgaatcactattttatagaactgaatcttatcttccctcttgatttgtaatttagatcatatagtctggactataatgaactgtgtcagtgtggagaaggcactatctaggcatgcccatcaaataatgacagcataatgaaaagtctctctcaaatttaatgaaagccaaaatgtaagagcaatggtctcagctggcagtgagctacagtaatcattacacagaaaatggtcagaagaatgatcttgtgcaagaatatttcaatttaagaacaaagattacattatgtaagggggaaaatgacttttgtgattattgctggaagtaaacaaggccaggaaatacctggaaagcttttgtaaaatgccattcaacaaacacttggcctcctcaatatagtcaagaacgtatgtttctaatctagaaacatttgctgactaaaaataatgagttaggccaggcatagtggctcatgcatataatcccagcactttgggaggccaaggcaggaggattgcttgagcccaggagtttgaaaccagcctgggcaacatagtgggaccctgtttctacaaaaaaaaaaaaaaaattaattagctaagtgtggtggcatgcacttgtagtcccggctatttgggaggctgagtcaggaggatcacttgagcctaggaggttgagactatagtgagctgtgatcacagcactaccttctagtatgggcaacaaagcaagaccctgtctcgataaataaataaaataatgagttagttctgtccaccaaaaaggcctagaagcaataacaatccaatgtcaatgagcacccctagcaaccagattgtagtctctaagaaccatttctctctaaaaagaaccaacatccttggtagaaatttcaggtctttgtcagcaaatgtacaagttgggtggcatatctcgttacaccagaaagcaaagaagctctcagaaactattttagtgatgttaagagatatcacctagaaggggccacagatggccaattgagcattaaaaaaacatgtgtagaactaaataagacatatagaaaacattaaatccattagttcatcagatactagaagagtgtgtgtctctgtacatatataaatatatatatatatttatacacacacacatatataaaggcagggggagggagggaaataactcattagacaccgatgaaagttcctaggatatcttatttttctctaaaatgataattaaaagaaaagaattgagcatttattctgcctctctggtatgaattatacttcagagtattctaacacctgaagctgtggtgggtgaatgacagtattctctataaaactactttagccaataaaaaatacaaaaggaatgacagaattcaaaattacctttttgtcacctctagcaaaatgacggaatcaggcaatgttcatcaatggatggtaaaacaattaagtttaaggttgatgggaaactttatagtggattagactgtcaccaactgaacccattgctcagtcttagcattactaaaagtacatctcctaatgtgatgaaatatgaactacatagcaccatctacaaaataactgccaaaatgaaactgcttaaaattttttataataaacttaaaaaaacaggataattgggagaaatttatgattttaacatcagccttctggaacatagtccactggccacagttctttatggatcactgagagctgttcagtgacctcattctcaagttctctcagtaccctggaatgtcatttgcctgagccagaagacaaattcatttagagtgagtaagtccttatttataatcttttcatagaacttgggctccaaatacattttaccatgtttaataccacatatccagataattctctttgatacacaagtatcaattgctttttgtcttatattctttatggttagacttaggttctatacagaatgttactatcatactctcatttatattattgtttgatgtgtaaatgtaccaatcaagttatgccctaggttttaaagtgacttcacaaggataattcggtaaaaatcctgacttttaagaagggctaaatctctagcattcagtgctaaattagaaaatggtaacaggggctgggtgcggtagctcatgcctgtaattccagcattttgggaggccgaggcaggcagatcacaagaccatctggctaacatggtgaaacctcgtctctactaaaaatagaaaaaattagtgaggcgtggtggcatgggcctgtagtcccagctactcaggaggctgaggcaggagaatcgcttgaacctgggagggagaggttgcagtgagccgagatcacgccactgcactccagcctgggcgacagagcgagactccatctcaaaaaaaaaaaaaaagaaaatggtaacaggtaaaactgattatggtacaactgttccactaccctgtcctcaggagcatcaacaattcccgctcccttcacatttgaacagtcctcgaatcttcttaaaggtatattaatggtaaggaacatgggatttagtgtcagatctgcatggaaaactaggctctgtcatgtattagccatataaccttgagcaatatccttactctctctgagtttcagtttcctcatctgtaaaatggtaaaaaaataatatgtagtcctcatagtattggaaagtaaacaacataacataagtaaagacattacaacagctggcacatagcaaacaatgagtaaatggtttatacaaaacaggatgtgaaggaatgagttaaaagtttgggttgaaaaacagaagaataatcattgcaatagagaattaaaaccagaggtgtagtccccaaattgtcactaatgatttcgtttggagagattatgggatgtactttctttttctgttctacatttctaaaatgttttagtttttaaataataaccatgtattacttttgaattggaaagaaatggaaatgttttcaaatacgcattctcttcattctcagtatctccattaaagttctgatgataatctcttccccagactcttccaagctggaatctcagcctcccaccccaagctattttctatgttgccaccagaactcctcatgtctagtccctggatgactccatgttgcctacagaatgacattcaaactccctagtaggacttggaaagctcttcatcatctggtctcagtatttccaacttcatacggcacccttccctctgactcacacagaactctagtcacaccagaattcttgtcattctccaaacacataaaatctcttatatactttcacctttctgtgggccgaaatggcaatgaacaaagtgatcttagatagcacatgctgaagatgacagaaccccctgatgaactagaacatctgctctgcactattacatgagaaatatacttatcttgttgtggagccaattcactttggggtctatgtgttatagaagctttgtatcccctaactaatagatgatacaaggatctttccctttccagagctgaaagaaacaattctccagtaaaacaattattttgtacccaaaacaaaagtaatcatagtacactactttgctcactagtgaataataactgtgcaatcataataatctaaatgtgattattaaaatttaaaattatgataaagtttattaggaagataagggaaaggaaatagaataatggtggcagtaaaaagactatcatctagtttatcttgtcaaagatactgcttaaaattgataagtgaaaaattagtataagcccattatttgtaacacagaggtaaatatatgatgaaaacaatgatgaacaaataaaagagataaaagtggttgtctttgggtaataggactgaaaaatagagaagaaagaggcaaagaggccaggcgcagtggctcacgcctgtaattccagcactttgggagtctgaggcaggcagatcacttgaggtcaggaggtcgagaccagcctggccaaatagtgaaaacctgtctctactaaaaatacaaaaattagccatgcgtggtgatgggcacctgtaatcccagctacccgggaggctgaggcaggagaactgcttgaacccaggaggcagaggttgcagtgagccaagatcgcatcactgtactccagcctggacaatagagcaagacgctgtctcaaaaaaaagaaagaaagaaaagaaaaaagagacaaagaactgctatttattgatatatctgatttttaaactatgtattattttgatacaattaaatatttaaaatgtacaagagagaaaatgaacacaggtgagatggactaggtatgaaacagcagaattgaaaacaggaatacaataaaataaagagacgtcctggtttgagatggtggagtagaaagacaaggggaggaagaagatggtctgctgtcctcaagctttgctacacctagatctccagtctttatgattcagagtagcctccaaatgcccaagaaacatttataaataagtatacataaaaataataatcagggattctatcacccacctcgacttcagttttatggcttccctatagacccatatacattcaccttggcagatgctagctactggaaaaactctcatacctgtatttcatttcccagaaccagaatatatatgtgtgtgcttatgtgcgtggtgagggcattcaatctcatgcaagcaggaaaagggtaagtgggcagctaggaatagggcagatagggaagcataagcaatactgtaataggaagagacagaaatagcagaaatgtggaggaaaggaaggcagtaaatggaaacataacatttagaaacattaaggtgcaaagaaaggattttgctgcagtaatcatagagacagatctggagggctgacctcacacatgacaaatacctttactgcagttccaaaagggaactcatcatatctcaaatgagactaatgctatgcacttttaacaactattaaaaacttagccctacttgaaaggaagccatgtacctaccctttgaggagcataaacaggatatgaggatgagcactaatatactccacagtaggactccgagtgcctatctgtcttctcaagatgttgttaaatatctgggtcacatctttttttccctgttaaagaaacaaacagaaattaaattgtacactctaaatggatgaattgtatagtatgtggaatatatacatatatatatacacacagacagaaatggtaccatcctttctaatatgcaaaaaaacgttaacttactcttcccatagacccctaacaagctgtgcttgcaaacacagtctacaaaatggatgcagctccttgccacaggatgtgtgctgggggaaatttgaccaacgagaaatccatttcccacagagcatggaaggacataaagtgaatatgacagaactgaattctttgttttttcactgtctacctttatgcaagaaaaaaattatgattatcatttttaaaccttcatgaataaggaaggaaaacagaagaagaaaataagattttagtaaaatgtaggttagaaccaaattcctttttcttagatctactttctagtattttttgctttcacgttatcactttattcactgttcttcaccctagtgccttgacttaaaaaataaagtgggttttccattagctggaaatatttgatctaggtgatcataacaaatcacatctagcctagaggaacagaagagatcaccgaatcagtgagacagaggaaccagatatgcaatcatggatagggcttcttagagtcctcatggacaagacctgcactctcatacaccttacaacctgtctagcctggttttccaaaagaaatcttggactggacctgagtttactatatgaaaaataagtacaagaatgactgatatggtttggctctgtgtcctcacccagatctcattacgaattgtaatccctataatccctatgtgtggagggcaggacctggtgcgaggtgattggatcatgggggtggtttccctcatgctgttctcatgatagtgaatcagttctcacacgatctgatggtcttatatgggactctttcccctttgctcattcactcttccttctcctgctgccatgtgaaggtctgtgcctgcttccccttccgccatgattgtaagtttcctgaggcctccccagcaatgtggaactgtgactcaattaaacccctttcctttttaaattactcagtctcaagtatttccttatagcagtgtgagaacatactaatacaatgacattgcattctcaatcagtatggccctagttctggccttcatctctcaactaaactatgaaagagcttgcttcagttactgtctccacttcaaagcatcctcaccctgcagagtgagctagctagaaatgcaaatatgaccatgccatctctctccttaaacacttcaacgtctcccttttgcttagaaaaaagtccaatacaaaaaggccaggcgcagtggctcacgcctgtaatcccagcactttgggaggccaagtggggcagatcaagaggtcaggagttcaagactagcctggccaatatggtgaaaccccatctctagtaaaaatacaaaaattaaccggctgtggtggtgtgcacctgtagtcccagctacttgggaggctgaggtagaagaattgcttgaacccgggaggcagaggttgcagtgaaccgagatcgtgccactgcactccagcccaggcaatggagcaagacttcatctcaaaaaaaaaaaaaaaaaaaaaaagagacagaaagaaaggaaagagagagagagagacagaaaaaaagagagagaaagagaaagaaaagaaagaaagaaagaaagaaagagagaaagtccaatacccttcaatgacttgacagcagccaacttttccagtctcatcagctaactatcacttccaattcctacatcaagttctattagtaccaaattgctgcaccacatatacacaacattttatggttctatatctttgttgatgctcttccttttttcatgaactctgtcattctttaagattcagttcaggagttttctcccctgggatgagtgcccctctctgtactacaaccatgtcctttgccacatcgatcagtacctcctctttcccactacctctacctccaccttcacagcagcaaatacttactgagtgcttactctgtgccaggcacttatgctaagagctttacaggtattatccaattttcacaacaaccttatttttttaaatttcatattctttttgttattttttttctggcatgcatacaaccaccttataatatacatattataaaaaagaaattaaggatgtataatatatgttttataaaatgtacaaatgtaaatatgtatatatacatattataaataaggaaattaaggattattgagattgcctagatctcactgtcctgtcagatactgataaatatctacaagcactaacaccatccaagaaaacatgacctcaacaactgaactaaataagacaccagggaccaatcctgggacaatagagatatatgacctttcagacagagaattcaaaatcactattttgaggaaaatcaaagaaattcaaaataacacagagaaagaattcagaattctatcataaatttaatacagattgaaataattaaaaataatcaggtagaaattctagagttgaaaatgcaattgacatgctgaagaatgcatcagagcctcttaacagaactgatcaagtagaagaaagaattagtgagcttgcagacaggctatttgaaaacatgcagttagaggagacaaaagaaaaaagaataaaaaacaatgaagaatgcctacgagatctaggaaatagtctagaaagggcaaatctaagacttactgaccttaaagaggaggtagaaaaagagataggggtagaaaacttactctaagagataatatccgagaacttcccaaacctagagaaagatatgaatattcaagtataagaaggttatagaacaccaagcagatttaaaccaaagaagactacttcaaagcatttaataatcaaactcccaacatcaaagaaaaaaaaatcctaaaagcagcaggtgaaaagaaacaaataacatacaatggagctgcaatatatctggcagcagacttttcagtggaaaccttacaggccaggagagagtggcatgacatatttaatgtgctgaaggaaacaaatcttttaccctagtatatctggcaaaaatacccttcaggcatgaaggagaattaaagactttcccagacaaacaaaagctgagggatttgatcaatactagacccatcctacaagaaatgctaagggtagttctccaacctgaaagaaaaggatgttaatgagcaagaagaaatcatcttaaggtataaaatccactggaaacaggaagcacatagaaaaacacagaatagtataatactgtaatggtggtgtgtaaactactcttgtcttaaggagaaagactaaatgatgaaccaaccaaaaataataacaacttttcaagatataaacagtgcaataagacataaagagaaacaacgaaaagttaaaaagcagggggaggaagttaaggtgtagagttcttattagttttctttctgtgcatttctttatgtaattagtattaagttgtcatcaatttaaaacaatgggctataagatggtatacgcatgcctcatggtaacctcaaatataaaaatacaatggatacacaaaaaaataaaaaacaagaaattaaagcatagtgccagagaaaatcacattcattaaaaggaagatagaaaggaagagaagaaggaagagatgactaaaaaacaaccagaaaacaaataacaaaatggcaggagtaagcccccacttgtcaataataacattgtatgtaaatggactaaagtctgcaatcaaaagacataaagtggctacttgggaggctgaggtgtaaggatcacctgagcccaggaggtcaatggttcagtgagctgtgattgtgctactacactccagcctggatgacagagtgagaccctgtctcaaaaaaaaaaaaaagaaaagaaaaagaaaaaagacacagaatggctgaatggatgaaaaaaaaacaagacccaaatgatctgctgcctacaagaaacacatctcacctatgaagatacacatggactgaaaataaagacatggaaaaagatattccatgctaatgaaaacaaacaaacaaaaccaagcaggagtagctatacttacatcagacaaaacagatttcaagacaaaaactgtaagaggagacaaagaaagtcattatataataataaaggagtcagttcagcaagaggatttaacaattgtaaatatatatgcaccaaacactagagcacccagatatgtaaagcaaatattattagagctaaagtgagagacacatcccaatacaacaatagcagatcttagacctgggacatgataacttttaccactgttactcaacataatattggaagtcttagctagagcaatcaaacaagagaatgaaatgaagggcaaatattattagagctaaagtgagagacagatcccaatacaacagtagcagatcttagatttggagcatgacaacttttaccactgttattcaacataatattggaagtcttagccagagcaatcaaacaagagaatgaaatgaagggcatccaaattggtagggaagaagtcaaattatccttgtttgcagatgataaaaccttatatttggaaaaaactaaagactccacaaaaaaactattagaattgatgaacaaattcaataaagttgcaggatacaaaaatcaacatacaaaaatcagtagcatttctatatgctaacagtgaacaatctgaagaagaaatcaaaaaagaaatcccatttataatagcaacaaataaaattaaatacctagaaattaacttaaccaaagaagtaaaaaaatctccataatgaaaactataaaaaaatggatgaaagaaattaaaaaggacatgcaaaaaaggaaagatattccgtgtccatggattgaaagaaacaatattgttaaaatgttcatactacccaacgtaatctacaggttcaatgcaatccctatcaaaataccaatgacattcttcatcgaaatagaaaaaaccatcctaaaatttacatggaaccacaaaaaacccagaatagccaaaaccatcatgagcaaaaagaacaaaactgaagaaatcacatgacttgactttgaattatactacagagctatatagtaaccaaaacagcatgatactggcataaaaatagacacacagaccaatggaacagaacaaagaatccagaaacaaatctacacacctacagtgaactcattttttacaaaggtgctgagaacatacattgaggggaaaagacagtcttcaacaaatagtgcagagaaaactgaatatccacatgcagaagaatgaaattagacccctatctcttgtcacatacagaaatcaaatcaaaatggattaaagacttatatctaagatctatgaaactatgaagctactaaaagaaaatattggggaaactctccaggacattggtctgggcagaaacttcttgagcaaaaccccacaagcacaggcaatcaaagcaaaaatggacaaatgggaccacatcaaattgaaaagcttctgcacagtgaagggtacaatcaacaaagtgaagagaaaacctacagaacacaggccttctatgaaaaggtgctcaacatcactgattatcagagaaatgcaaatcaaaactacaacgagatatcctctcacgacagttaaaatgcctttcatgtaaacgtcaggtaacaactattgctggtgaggatgtggggaaaaggaacccctcatatgctgttggtaggaatgtaaattagtacaactactatggagaataatttggaggttcctcaaaaaactacaaatagagataccatatgatttagcaatcctactcttaggtatatgcccaaaagaaaggaaatcagtatatcaaagagatatctacactcccatatatgttgcagtattgttcacaatagccaagatttggaaacaacctaaatgtccaaaaacagatgagaaaatgcggataaagaaaatgtggtaccctatacacaataaagtactattcagtcataaaaaggaatgagattctgtcattgcaacaacatggatggaactggaggccattatgttaagtgaaataaaccaggcatagaaagacaaacatcagatgttctcagttatttgtgggatctaaaaattaaaacaagtgaactcatgaaaatcaagaatagaagcatggttaccagaggctaggaagggtagcaggggagtgtgtcagggtgagatggggatggttaatgggtacaaaaaacaatagaaacaatgaataagatctagtaacaccaaggataaatgcttgagaggatggatacccaattttccatgatgtggttattacacattacatgcctgtactaaaatatctcatatacactacctactatgtacccacaaaaattaaaaagaaaaaaagagaaaaaagaaataaataaaaacccatgctctcacgaggtcaggagtttgagaccagcatggccaagatggtgaaaccccgtctctactaaaaatacaaaaattagctaggcttggtggcacgcacctataatcccagctactcaggaggctgaggcaggggaatcgcttcaacccaggaggcagaggctgcagtgagctgacatcgtgccattgcactccagcctgggcaacaagagcgaaactctgtctaaaaaaaaaaaaaaaaaaaaaaacccatgctctccaaacaccctccctccaaaacccaaccccccatcaaagcccaaaaaacttaatagtatgaaaaacaaacaatctgccaggcatggtggctcacacatgtaatcccagcactttaggaagctaaggcaggcagatcaccagaggtcaggagttcgagaccagcctgaccaacgtggtgaaaccttgtctctactaaaaatacaaaaattagctgggcgtggtggtgcatgcctgtaatcccagctactcgggaagctgagacacaagaattgcttgagccctggaatgagctgagattgtgccactgaattccagcctgggcaacagaccaagatcctgcctcaaacaaacaagcaatctaattagaaaatggataaaaggctgggtggggtggctcatgcctataatcccaggcaagaaattactttggaaagctgaagcaggattacttgagccaggagtttgagagtagcctgggcaacatagcaagaccccatctctacttaaaaaataaaataaaaataaacaaaacagagaaaatggctaaaagacatgaagacacattttaccaaagaggatatacagatggcaacaagcacataaaagacgttcaacattgttagccattagggaaatgaaaatcaaaaccacaatgaaatattattacatgcctatcagaatggctaaaataaaaaatagcaacaacatcaaatgctggcaagaatgaagagaaactgtactcatacattgtagtggaaatgtaaaacagtatagccaatctggaaaacactttagcagttcctgaaacagctaaacatgcagctaaccataacagcaattgcgctcttggcatctatcacagagaaatgaaaactatgttcacacaaaaaccaattagtaggtgaatcttcaatttaaaagaatactccaaaatcagttgctctcataattttaaaacactaaaaaatgtttataggccgggcacggtggctcatgcctgtaattctagcactttgagaggccaagcctggaggctcagttgaacccaggagtttgagaccagtctgggcaacatggtgaaaccccatctctacaaaaaaatacaaaaattagctgggtgtagtggcacatgcctatagtctcagctatttgggaggcttatgtgggaggatcacttgagcctagaaggtgtaggtggaaggtgtaggttgcaataagctgagatcatgccactgcactctagcctgggtgacagcgtgagaccctgtctcaaaaaaaaaaaaaggttgaattacataaattttatttatactgatgttaaagactatatttgctgtataaaaaaagatatagctgtaagcataaattgattttaaaatgaaagaaatcatctgtttcgttcaaacctttctagaccctgcagtgtaatattgcagaataaatatcaaccctctttgaaatgtcataggaacatgtttttcatacttcccagtgaaatgtcacaagaacattccatacagcattccagtagaaatgaagctctgcagaactctatccaacttttacatagaggaaaacattcttctagttcattagcaaatgtgtgcaaaggcaaaggaagccccctgtggataacaaaagcaggttctgctaccagggaccgcttcccaaaacagaggaaaggattagaatagaaaggattacagaacactgaaacaggtacaagctggtgaataatgatctctacattacacgttaatctttgtagctatcaatttgtcatgccaaatctaactggagtgaaaccttaactatttcaaaaccagttttttgcaacccgcaggctgccagatctcaagccctggactcagaagtggccagaaaaaaaagacagaaaaaccctaaaaatatatttgataataaagaagcaacatccagaaatggcccaaaatgccaaaaattagctggcaattctaaggttacatacaatgtaaccaataagatcccaaacctgaagaagcccttgtgtttgctggcaaattcaaaaaagtcagctttaacatgaaatgctccataattatttgctgaatgaatgaattatatatatggaagtattaactcaaatcaaataagaaaagagaaaaggagggaagaaagaggtggtgaacagcagtcacagcaaccagaatgattgctgaaaaagagcatccctcacagatagcatagatgagaaaagggaaatgagaaaagaaggcggagactagaaaacacccacttcaaaacacaagccattgacttttatatagaatatatataaagaattctcaaaattcagcaacgaaattaaaaaggggcaaaagatatgaataaatacttcataaaagaagagatatggtagcaaaaatgtacatgaaaagatgctcaacatcattagtcattagagaaatccaaattaaaatcacaatgagatatcacaaacccttattagaatggctaaaacaataaaacaaaacaaaaagttgacattccccaacagccctactcctaggtatttatctaagtgaaaggaaaacctatgttcacactaaatactatacataaatggttaacggcagctttatttgtaattgctagaaactggaaatatgtaaaatatcccacaagtggggaatggataaatgatctgtggtccatccatgcaatggactactactcagcaataaaaagcaacagactcctaatacatggcaacgacatggatgaatctcaaatgcgttatgctgacagaagccaggctcaaaaggctacatatatatgattctgtttacccaatctttttgcaatggtgaaaatataaggactgaaaactgatcaatggttgccagaggccgaggacaggaaaaggagatgattacaaagaggcaaaggagatttttttttttttttgagacaaagtcttgctctgtcacccaggctgaagtgcagtggcataatctcgactcactgcaacctccacctgccaggttcaagtgattctcctgcctcaacctcccgagtagctgagactacaggtgcacaccaccacacccggctaatttttgtatttttagtagagacagggtttcaccatgttggccaggatggtctcgggctcctgacctcatgatctgcccacttcggcctcccaaagtgctgggattacaggcgtgagccaccgtgcccagccggcataggagaattttttagggtgatggaactgttgttcttcattacagaactgtgcactaaaaagggtgaatgttactatttataaattgtatcataatttttaaaaatgaaaattatagccagtgaagtcagggacttctctattcttgctggtgtgttgcgggggagttgaggtgggtgggagcaagtggttgtgctgaatttcagtagcagaagtggataggcagaacagtctaccgggtgaggggtagccactgaatggattagtgagggatcttgctggggactaaaattcaaattggactaatttatagatattgggaaagatatagggaatgaaactacaagctagctcaaagttgctctcaaaaaaatttaaatatattaaatttatatattacatgaaatccatctgtgggaatttatatgggagattatctcccccactgccccaatatctttgtcattctattttctctgcaggctggcttcttctgtttctttaggccacatagtgaaaaatacgaccactgatggaaaaactgcatttactatctttagcacctggctaaacactggggttctgtctcagttctagttccagaattcctgcagaaagcctctggccctcttttggtcagatatccacttgcagatcattcagctttgtgttgtccagggtgtcatatcacccaaaatggttgttcccatggtaaccatgtgagtggagaaggagggagcattccccagaaagcagagggagtgggcagacacaacactttatacacagcacaagcagtcttcatccttatgcagattacattccttaaaatgtctggtacgatcaaactaatggtcactgtcttaattttattacaaacaattaacaggtttcacatctaattaagagcctgatgccaaatgccatttttaatcacccataaattatattcctttataggataaaggccttctaaagcttatattcattaagctttagggcaatagggtaatgataacataaaatgccattttctatgacatagtatttccctacctgagattgtaaattctttaatttgtccagtgaggggcacaaaatatatacacaatcaaataaaatcaagaccaaacataattaaataaaatcaatggctgacacgcatagtaagcatttcaaattgttaaatgtataatgtacagttaaagctggtattttaaggctttatgatttctgttatatttttacagtaataaaaccaaaggtaaagagccatttttttttctttttctttttctttctttttttttttttttgagatggagtttcactcttattgcccaggcagaagtgcaatggtgcgatcttggctcactgcaacctcctcctcctgggttcaagcgattctcctgcctcagcctcccaagtagctaggattacaggtgcatgccaccatggccacggctaatttttgtatttttagtacagatagggttttgccacgttggcgaggctggtctcgaactcctgaatttaggtatcccaaaatgctgggattacagacgtaagccaccacgcctggccaagggccactttaatcaggtccagggaatagaaaaagattattagaggataaacatttacaaaatgtaggactacaaaatggcttaatgaaaagtggaaaagttgatcctggagtgtttgttttgctatttttttttcttttgagacagggtctcattctattacccaggctggagtgcagtagcacaatcttggctcactgtagcctcaaccacctgggcccaggtgattcttccaccttagcctcctgagtagctgggaccacaggcaggcatactctgctaattttttttattttttgtagagacagggttttgccatgttgcccaggggggtctcaaactcctgggctcaagcaatcctcccacctcagtctcccaaagtgctgggattataggcgtgagccactgcactgggcctgttttgctaattttttttaatgtagcgagaaataatcattagggattaagttaccatagaagacaattttctgcttctttgagctgcttattcagcctgaacagttcactttgcatccaccctggttttgcaaggcacacctgcctttaaaatgaatgtatcagaccttacaggcaatacattttccctcctttgatctcttatcacgttgtgtttcaaaacatcaaagagtctaaagctgtgtcttgaatagtagccaaacctcaaaaaacacagctgagtttgatcctgagcccataaaaatcagaagccttgcaaactcagccacaaatcattttttgaacctcataatagtgtgctgaaatggttcttttctgtctgcaattttaaggcttaaagcattagataaaaatttatagctacataatgagatttttatttaacccaaaggccgacctcctaactagccattattcacatgatgatagccggatcctccagtattgtccctaccccagtgggccactttcctctagattcctgacagagaagtaggtttgtcaaagattcctgagtcagtccctgccatccagtttaagtcagtgctgccagccaccatcactgctgtcagctcagggttccaaacccctgctcccagcgcccttcaacccccattcattgccttgtttcctgcaactgcttattttttcagcactcagtttactccaagtgtagaaaaccaccccttcttcactcaacttgttttttgttgttgtttttgtttttgttttgtttggagatggagtctcgctctgtcgcccagtctggagttcagtggtgcaatctcggctcactgcaagctccgcctcctgggttcacgccattctcctgcctcagcctccctccagagtagctgggactacaggcgcccgccaccacgcccggctaatttttatatttttagtagagatgaggtttcaccgtgttagctaggatggtctcgatctcctgaccttgtgatccgcccgcctcggcctcccaaagtgctgggattacaggcatgagccactgcgccggcctcaacatgtattattagtacaaagttcctttacaaaggtttaaggtgaacaaaggataatcacagcacagtgcagaaacaccttcaagctgaagtctacagatcacttttatgaaaggttcctcagtcttcctgatcatctttctccatgaacatcttccttttgtcatggttctggatacctctctctccctccctccaaacctttctcctttcttctatttcctactcctatcaaccttggccaaagagggcatttctcaaatttctgttacttttctctgccaaggaaatctaagcttttttctttcagtcttttccttacagacattgcctagagacttcagcctttcaaactaacaaaaaagccaatcaaggtatcttctaaacaaaaattcactttttttctctgtaaggaatgtgccattctcctaggttatctggcaaaagctgtagtccatccttaaaataataatttttcctttctgttatcaaaacataccagaaattttacagtcaaatgactgttctgctatccaaagaagcaccaggagaggctattcacgtactgaaatcatataatcatcaccccaaagagtttgaattatcttctaaacaatttactgattccttcagaaaaatggctcactggtatgtcccaataccttcttttggtccaattcttttacctctgctttgatatctcattctcattactacattcattcaaacaattcacaaattaacatgccactaggtgtggcaaacacagtcctcgtactcaaggtaacacagaagtggctgtcccagtgcaagccatgaaccaagagacatgggggtgggggttctgtgtcgctggagtaagtctgaagtcagaaggaattttatcaagctgtcagtagcttacatagatactttaggcttgagaaggagagttgctgcctgcaggctgatcatccatgcctccagttcatagagataacatagtacatttctataagtaggctaataatgctaggaatgctggctgcctccttcctgaaaatactgtatgtagttggaatgcttaaaatggaactgtactaaactttcactccttttcattcattcatttattcattcaaccaggaagtatatatttttctacaggctagagaaggataacggctgcatctatggagtatcacattcacttataattatgttctaggtatgtgtcacgtcaattgaataaataaagttaagaattgcctatcttattatcacaataacaaatcttcataatagttttgaatcatcagtttaaaaacgtattatatctagtattttattctggagggaaggcaagtatataatacattttattttaaaaattaaagtaatccacaagagtaatcaatttaactctgcatttgaaggcttaatcttcagctatatggaaaattcaaatgttcagaaagatacttcttttctccaaggattccagagaataaaagtttacttgataaaaatgtacaagtctattttaggcaattaaatgtcttaattccaaaataatttttaaatgaacttcttctcaaaatttttaatttatatttgatgtgccacataaaagaaggggaacttgcataactgtttcttacattccacttttgttatctgagccaatgccaaagaaagttataaggcacccaaagtttttctttggtatactcctccctaactccccaattcttggaaagcactttgaacctatgaggttctgtggctgctcaaagcttctacaggtcactgaacctgacgacatctcatccctgactcattcttcaaaacataaccatccttagtcatattccttctagcactccactgcaaattgggttaatctcataaactaactcaagcgtacttatgaattaatgacgacagtagcttaatatgctgctgttctcagagaaacaagcaaaacaacagaaaatttataaaactatactactataagaatagggaatcattttcctatttatggtcactgaccaactaaatctaaaaaaaatcaagggttataacaaaaacaaaccagcttacacttaactttagttcctgagtttgagaaaaagaggaaatgaaaaaatactactacttgacatttgtatacagtttgcatttatatttagtgtccctatataacacaacatatatatgtatatatttttatttagtttaatatttaaaacaatgcagtaagttcgtattattcctattttatagatgagaaaacttaagctcaaagaggttaagttactgaccatgaaagagcagagctgggactctaaacaattctaattccgagtcaagtgtgtttttcactatgccacagcttctacaagtgttcataatacctaattttaaactaaataaaagaaacagaaaagtatatacatacagtaagactatactttaatttcacatatagctgattttaaatctaagatggagacctaagatggagagggagagtaagcaagccaagcaagaggaaaaagaaaaagattctgagcaaactgtcgcaaagacaaaaaaccaaacactgcatgttctcattcataggtgggaattgaacaatgagaacactgggacacaggaaggggaaaatcacacaccggggcctgttgtggggtcgggggagcggggagggatagcataaggagatatacctaatgtaaatgacgagttaatgggtacagcacaccaacatggcacatgtatacatatgtaacaaacctgcacgttgtgcgcatgtaccctagaacttaaagtataatttaaaaaaattgaaaaaaaaaagaaaaagattatgggtcagaaaatgccaaaggcagagaaagagatagaataaggaagggaaagaaagaaaaagacagctgtaactgaaaggatgagctgaagtctgggcccttcggggtccccacttggtcttgcttctagccacaactggactgcacgcctcctggctctgcactcctcctcctctgcttcggctgctaaaatcttccctggtctaacttgtgcagagagctgtaggctactacttccacagatccccaaagccctgacctgatcttggtctaatcacagtaatcactgtcattagttttccttccacttattcagtgaacaaaactaaaagctattcactttgcatatctcctctatctctgagaatgaatggagacccaagtacctacctgatacgaacaaaattcgtattatgatagaaacaaagcaacaaagccaaaccaggacttctgtcgcctcaacagtcaatgcccaaacttgtctatgtatccatttctcactgaaaaatcaccacctctgagttacacaatagataataaaatgactagacatattcaccacttacatttctaagcttttgttttagttagtcagtttattatttaggtaaattaggtataattgccttcaaaaggagataagtatattactagcacttaacacatttcttaaatcattggtataatatgttcattaaaagaactgtctgaatttgaagctctgaagtaagtgagtgactttgggcaaattacttaatatctttgaactttaggttcttcatctataacatggggctaataatacagtattaaacacaaaggtagttttaagaattcaacgagttgaatgcttgaaactgtacctggcatatagcaagcattcaacaaatgttacttcttattattacttctattaaccgttatctttgctacctagctgcataaaacttaactatagtttggctttttgcttttgtaaaaaatagattaattgtagacattttagaaaaaactttaaaaaataacacatggaaagccataatgaaaagcaaaagttgaatagtagatagatagatagatagatagatagatattaaaattgaaaagcaccactgacatccttttacagctggcttacctcaaagtctatcagctgcaggtcagctatcagtgtcactagcaggccactgctgtagagttcttgtgctagctgagccactgcttctgttgggggttctttctcgtttgtaccacacagaatttctttcattgcttgcagtgatttagacacttcttctgaagcctagtgaccaaaacgtatgctaacggttaaaagaataaaaatgtttaggccataaacaaacaaacaaataatccaaaaaaccacttcttggtcttgggctctgtttatttataatgaatggcacagttacaaacaaacaaaaacagtgaggggaatcaccatgtttgggtggacctagtttctaatggcttgcatttacatatcaaaggttgccagcctggctctaagagccggggctatacaagaaactttttcggctctccctctccctctccctctccctctgtctccctctccccacggtctccctctcatgcggagccgaagctggactgtactgctgccatctcggctcactgcaacctccctgcctgattctcctgcctcagcctgcccagtgcctgccattgcaggcacgcgccgccacgcctgactggttttggtggagacggggtttcgctgtgttggccgggcaggtctccagcccctaaccgcgagtgatcccgccaacctcagcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcttctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctccgcccggcagccgccccgtctgagaagtgaggagcctctccgcccggcagccaccccatctgggaagtgaggagcatctccgaccggcagccaccccgtcagggagggaggtgggggggggtcaaccccccgcccggccagccgccccatctgggagggaggtggggggtcagcccccccgaccggccagccgtgccatccgggagggaggtgggggggtcagccccccacctggccagccgtgccgtccgggagggaggtgggggggtcagccccccgcccggccagccgccccgtcgggaggtgaggggtgcctctgcccggccacccctactgggaagtgaggagcccctcagcccggccagccaccccgtccgggagggagatgggggggtcagcccccccacccggccagccgccccgtccgggagggaggtgggggggtcagccctccgcccggccagccgccccgtccgggaggtgaggggcgcctctgcctggccgcccctactgggaagtgaggagcccctctgcccagccagccgccccgtccgggagggaggtgggggtgtcggccccccgcccggccagccgccccgtccgggagggaggtggggggggtcagcccccccgcccggccagccgccccgtccgggaggtgaggggcgcctctgcccggccgcccctactgggaagtgaggagcccctctgcccggccagccgccccgtccgggagggaggtggggggggtcagcccccccgcccggccagccgccccgtccgggaggtgaggggcgcctctgcccggccgcccctactgggaagtgaggagcccctctgcccggccagccgccccgtccgggagggaggtgggggtgtcagccccccgcccggccagctgccccgtccgagagggaggtggggggggtcagcccccccgcccggccagccgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcaggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcgtgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaacaaaaaaacaaaaacagtaagcactgccttttttattttggaaaatattataagtattataaaatttatttatataaaacagctctttggtatttctacttagtcaacatacactaaataatcttttttttttttttttagatggagtcttgctctgttgcccaggctggagtgcagtggcacaatcttggctcactgcaagctccgcctcccaggttcatgtcattctcctgcctcagcctcccaagtagcggggactacaagcacccgccaccacgcccggctaatttttatacttttagtagagacagggtttcactgcgttaaccagatggtctcgatctcctgaacttgtgattcgcccacctcagcctcccaaagtgctgggattacaggcgtgagccactgcatccggcccagtaatcttttaaaccacactcattgtctaattttgctagcaattcaatataaactttatgcttgaaaattaaattgattccattttgaagacttatcagtagctactgatctttatttaaagcattgtgttaaggtttttcaacaaatccctattcctctgattttcgaatggtccaagtataagattgtaaattgtcaaaactcataagctttctttgtcaatccatttattcctcacacagaatcactgtcttttttgctatctatgaaacttaaaaaaaactcactatattttaaagaatactaggcaaatccatagaggcagaaagtacatagattagtaggtattagggcctgggggagagggaaataagtaatgactactaatggctccagggtttcttttgggagtgatgaaaatgttctagaattagatagcggtgagttgcaaaactttgtgaatgtactaaaaaccaatgaattgtacactttaaatagtgaattatatggtatgttaatttttaatatctcaatttaaaaatctttaaaattaatataggtaggaaaggagagcagattaatttagttaacaatttgtctgaatattttaaagaaatatactttcattacttttaagtataatattgtaatcattataaatgaagaaggaaatgagtagaataaggcaaattacataaaaataactcatggtagcatgatgcaacttttgttatttatttatttttatttttctctagttctgcttcttgggtgacgctacttttatttatttgtttatttttaagatggagttttgctcttgtcaccgaggctggagtgcaacagcacaatctcagctcactgcaacctctgcctcctgcgttcaagcgattctccggcctcatcctccctggtagctgggattacaggcacccaccaccgtgcctggctaatttttgtatttttagtagaggcggggtttcaccatgttggccaggctgatctcgaactcctgaccttaggtgatctgcccacctcagcctcgcgaagtgctgggattacaggcgtgagccactgcgcctggctgacactacttttaaaaagtaatttttcatatccttaatagcctgactgaagcaatccttaatgtactaaagaccggaagcatcttaaattgtgagatatatccacagaagagtgctttaaacatacatggagagtatgtttaagagagagttaaggataataataaaggaaacatctttatgaccatcacccagtcaagaaacaggacattttcagcacccaggagtcacctgaaggcccctttcagctcagatgtaaatatttttatatctcttgtgacaaacatgtctttacatttcttattattcctattttatagatgagaaaacttaggctgaaacaatatagcttagttccactgattttcaactttatggatcagtacattaccccttcatgacttgcttctttcattcaacattatttttaagaaatgcatctatactgttgcatgtaggcagaagttctttaatttttatcactttctaatgttccacactaatgcctataccacaacttttttattggttctactgttcaaggacattgggttgtttccatgaaaggatttttattaacaacaatgctatgaacattcttgtacatttttcctggtgcagatgtgcaagaatacctctagagtttataactaggagtggcactgcaggcacatgcatatcttcgtatttcacagataataaactggttttcaaagcagttacatcaatgtatatgtcatcatccacagttaatgaaagtcctcattgctctccatccttgtcaacacttaacatcatcacaccttttcatttttgccaagacagtagttgtgtaatctgaatttattgtggttttagttggccttttcctagttactaatgaaaatgtgtaaaaaggtttttttttcttttttctctcttctaccatttagatttatacttgcaaaaaagccatttttcttctatttgggccaagatttggctcaatattacaaagtgtactagaattagaataagctatttctacaccccttgtagaattcaatattgtatcatttactggaatagaaggatactatgaactcgtgtatttcttttatagatatcttgaatcttgccataaactttagagagaaatcgaatatataggattcaatatccctttgaaggaataactagcattcctatgaggaagccccacttaataagaccttaaaaccgtatgaaaatgagattcactgtaacagaaactatcagtcaatctttaaataaaaactttttacctttcatgtaaatgtaacattacacaccagtataaccttttagatctttaagctgtgtagtctagagggatccggtgtggtcagagtctctagagagtgaacctaaagttcatcacaacagactaaataataatcagttgcataaaacctgaaatcaacttaaatctatttatagagggtctatgtgcacatcacagaccatattttgaattcttcattaagcttttacattggtttttggcattgcgatgcatgtactttaatcataatgttactgttttagctcttaccttgtctgtctttttgtcttgcttttccaaaatggccaaattgtctttcaggattttcacaatttctgctggatttttgtgtgatttactaaacaaaggcatttttttcatgtgtagaaatctcttcttccaatatggaatgctaaaaacaaataagccaacaaaaattataactttaactcttaatatgcttaaatttttataccaatgtcttataagttttcaataacatgaattcagtaatctgaaacattaaaagtgatcaaattaaaatgagtttcaagttttatgccaaatttaaatacatatatttttaaaaagatatttttaaagttttgcttgaaagtttttatacaaagtttaaaatctttcctgcaatagaaacataaggattatacaagaaataattttagagtccaagttgatatgtaaaactagatattttgaccaaagaaagtgataataataataaatatattctataatgtttagctatatgtattctataatgcttagctgctattattacaagaagttccatgacatagttaatgaactatttcacaaaagagaaaggcacagtagtttagatatgattctatcttaaatgtcctagacatttctggctctttgagtcaattatacctttttccattattttaaaaaacataaacttattctctgaatgcataataatcaatgatcaaatattttgcattaaagtagaattttaaaaagaagccaaatgcattcatgtatagacatacctaggagatactgtaggttcagttccagaccattgcaataaagcaaatttcccaataaagtgagtcataaaatgtatttggtttttcctagtacatataaaagttatatttacgctatactgcagtctattaagtgtgcaatagtattatatctaaactgatgggtgcagcacaccaacatggcacatgtatacatatgtaactaacttgcacattgtgcacatgtaccctaaaacttaaagtataataaaacaaaaacaaaagcaaaaacaaaatgaaaacaatatgtataacttgatttataaaaatatttattgcctgacccttcagtgagtcctaatctttttgctggttggagagtcttgcattaatgttgatggctgctgactgatcaggttgttggctgctgaaggatggagtagctgtggcgatttcttaaaagaagacaataaagtttgctacgttgactcttcctttcatggaagatttctctatagcatgtgatgcagtttgttagcattttactcacagtagaactgctttcaaaattgaagtcagtcctctcaaaacctgccactgctttatcagctaaatttatgtaatattctaaatcctttgttgtcatttcatcttcagcaggagtagattccatcttaagaaaccactttctttgctcatccatagaagcaacattcctcacctgttcaagttttatcgtgagattgcagcaattcagtcacatcttcaggctctattcttaattcttgttcccttgttatttccaccatattggcagttacttcctccactgaagtcttgaacccctcaaagttacccatgagagttagaaccaacttcttctgaactcctgaaaatgttgatattttgacctcctcccatgaatcacaaatgttcttaatggcatctagaatgatgaatcttttacagcaggtttttctattaagtttgcccagatccattagaggaatcactatctatggctgcttgcatcttatgaaatgtatttcttttgtttgtttttttaacttttattagaacaatatgaacatatgaaatgtatttctttaacaagtctggaaagtcaaaattactcctttatccatgggctgcagaatggatgttaacaggcatgaaaacaacattaacctccttgtaaacctccatcagagctcctggatgatgaggtacattgtcaatgagcagtaatattttcaaaggaatattttattctgagcagtgggtctcaacagaaggcttaaaatattcagtaaaccatgctgtcatcaggctttgttgttccatttatggagcacaggccaaatagatttagcataattcttaagagcctagggtttttggaatgggaaatgaatattagctcctacttcaagttaccagctgcattagctcctaactagagagtcagcttgtcctttaaagccaggcactgactcctcctttctagctatgaaaatcctagatggcatcttcttccaatacgagggtgttccatctacactgaaaatctgttgttttgtgtggccaccctcaccaatgatctcagctagatcttctggataacttgctgcagcttctataaatagcacttgctgctttttcccctgcacttttatgttctggagatggcttctttctttaaacctcatggagcaatctcttttagcttcagacttttcttctgcatcttccttacctctctcagccttcacagaactgaagaaagctggggacttgctctggactaggctaaagggaatgtgtgtctggtttgatcttctatccagaccactgaaactgtcttcgtattaacaattagctgttttgttttcttattatttgtgttttcactggagtagcacttttcattttcttcaagaacttttcctttgcatccacagcttggctaacttactgatgcaaaaggcctagctttcagcctacctccgctctggatatgccttcctcactaagactaatcatttttccatcttttgatttaaagtgagagatatgtgactcttccttttccttgaacacgtagaggccacttatagggttatgagccagcctaatttcagtattgttgtatcttagggaacagggaggcctgaggaaagtgagacaggggaacggccagtcgatggggcactcagaacacatgcaacatttatcgattatgggcacagtctgtggtgtcccaaaacaattacaatagttaacatcagagatcactgatcacagatcaccacaacatatgtactaacaatgaaaaagtttgaaatattgtgagaattaacaaaatgtatcaagagatacaaagtgagcacatgctggtgaaaaaaatggcaccaatagacttcctcaatgcagggttgccataaaccttcaatttttcaaaaacacggtgtcttcaaagcacaacaaaggtgaaacacaataaaatacggtatgcctgtaattgctgtctttctccctgtagttctatagcactaagggaaagatatataactgtaggaattttaaatactccctgacatcaaaacagagtacaaattataacatggtatcatagatatgatatgattttttgtccattattactttgcttggttctcactgtaacaagctaatgctaatttacttaaattaaaaacgttttcagggtttccatgtcaatctggtgataagcattttctgattcactatctccccttttcatctgatggtgggtttgttcatttattcattgaataaataatctgagtaattactgagcacaggcactttgctaaatactagggatagagccacaaacaagaaaaacacaatccctgttctttgaagcctattattaagtggaaaaagcaaacattttagggcaatggggttatataatggggaaataacacacagtatactgcctcaatacaatctcctttaaaaattactttcatattttactatacctacttattgtaataagtataatatgattagtttaacaatgttttaaaatttcatcttatcattattcttctattttgggatccatattttgaaggaaatcaaagttcatgctcttaaactatgcttgagttccagcacccagaccccctgcaaattaaggcagaactctcctgcctctcccagttcttctcagaccatggccagccccactccattcccagactaaacacctcccccactcccagactaaacacctcccccactcccagactaaacacctcccccactccaagactaaacacctcctccatcacctggaaacttgaggctgcctttctcacactctgggcgaccatgctggtcactatatatacatctactccaatcacatcatttagcccactggtggtcatttaagcaatgaagcaagtagcactcaaaccttctacacaaacacaagacacgtaaactccctctagttgattgtaactgatctgctgtatgattcaaaagaagttaatcacccccttctaggtgtcacttgttctatctgtaaaacgaagttgttcttaaagtaagattgagcatcagggctctaggttattcaccactgtcccacacccattctgagtctttaacccccagtatcctatcatgataaagataaagccaaaaataaagtgcttaagctgggaacaaaaggaatggagaggcctgacaatggtgccttgtggggataaggtggcaggaaagtaatttttccataaagtctacctcagagttttaagaacatacattctgtttcagcaaagcaggcagtggggacaggaaaagacgcatgttagtccagaaggctgacactagataaatgcctcctaggcattgaaaacggtgttgagaccacgcacatcaacgtgccctcagcattaatgctgacagcaggccatgcagcacagaaatgttagtggactgacaatggccctgttatacttttcctcttccagcagtcagtaagcagaataaacaacaaataggttgtttattattattaaaggaacacaatgaaaggaaataaatgccctgcagacttgggcaagaaaggttgcttctgaaattaattctctataaagctagaacagatataaatttaagaaaagaagaaaaggagacaaaaagctcttttagacaaaaaaaagagctagccaaggtaaaagactgaaaatacacacatatatgcacatataaatacacacatgcccaagatgcagactgggaatcccaaactgcatagagcagaataacaatacagaaaatgggtctggggcaacttcaaggtacaaaattagttagtgtgcatgtattcattcgaaaagtatttactgagcacttataatgtactaggcactgaacaaggaaatacgaaacaaagaagcctcaaagggctcacgatgtagtgagagacacagacacgtgcaaaattttcccagaaggcgagaaaaggtcgaaaaaactaaaatgatgaagaaaagatatagagtgtgtatggatacatatctttatatctatataggtattttatagcgatatgaagaaaatggagtgttatcccctaacaaacaggtgttacaacaatggaggggggaggataggaagccaaaaacagcaaaggcattaaaactggaacagaatcaaagatataacagcgtaaacagaaaaacaatctaaacttgatcattcgaacgatttttctagttgagattcatgataagacccaacattcagtgtcttgcagcttttaaaataaacatttccttctcagatcacattccaacaaaatgaccttaaaaaaacaaacgaaagcataaaaatcaggttggttttagacttccatgaaccaaatgccccaaggccatggagaaaacctagagttctgataagtaaagtctataacaccataattaaatccttagccaatataccatttatgtgtgaacagatagtgtatatttactaaaaatggaacaaaaagatgagatggaatgaggcccacaaagagctcaacaaaattaatgctaaaaaatcagaaatagttcttgaaaaggagcctgtatattgttggcagaacatgtgggagggtgagaatctacaattataactcattcatataggaataaaaataaataaggattcaactaaagaagttaaaaaggaaactgccccaaaaatctccaagaaaagatggatggaaataatgatagaagtagaaataactcaatcagagaagtaaaagaaaaggaagaaaacctctggtagctatttggtccgggtttcttctggtgatagatgtgtctgccctacttcccacatcacctcaccccaacaaaagcgggggaacatgacccaggtttggccacagtattccctgtcctggatgcagcaactagctagtaaatagattgtgacatagccaatcaaaataaaaaagaagaaagaaaagtgttgatgagaatgctgagaaaagggaactcttgtacattgttggtgggaaggtgaattagaacagccactataagaaacggtgtggatgatatgccaaaaataaaaatggaactaccacatgatccagtaatcccacttctgggtatatatccaaaggaactgaaatcagtatgtcaaggaaatatctgcacttccgtattcattgcaaccttatttacaatagccaagacatggaaccaacctaagtgtccatcaaaagataaatagataaaaaatgtagtacaggctgggtgcggtggctcagtcctgtaatcccaacactttgggaggccaagatgggtggatcacttgagtccaggagttcgagaccagcatggccaacatggggaaaccccgtctccacaaaaaatacaaaaattagctgggtgtggtggcaggcacctatactcccagctactcaagaggctgaggcatgagaatcgcttgaacccagggggcagaggtttcagtgagccaagatgtgccactgcactccagcctgggtgacaaaacaagactctgtctcaaaaaacaaaacactgctttaaaatagattcaaagcagagacaaaagagaaaatggctatatcttcattcgatatagccaaattgctttctcaagtttttattccagtttatactttcacagctgtgtagtgtgagttgcagttatcacccatccttcctaacatttggacctgtcagaatttaaaaatttcgccagtatgacagctgtaaaaggttgtcccattatggttggagtgcagttgtgtaataaccgcttgctgcagtcttgacctgttgggttcaagcaatcttcccacctcagcctcccaagtagctgggaccacaggcatgtgccaccatgtccggttaatttttgtatttttagtagagacggggtttgccatgttacccaggctggcctcgaactcctggctaattttaattttatgtagagacatggtctctgtatgttgcccaggctggtctcaaactcctgagtttaaatgatcctctcaccttggcctcccaaagtgttggggttacaggtgtgagccaccacacctgacccatactagctttttaactttcttattctgtacatttcctaattctatactttgcccatttcatatttaaaaaaaattttagagacaagttcttgctctgtcacctaggctggagtgcagtggcagtcacagcttactgcagcctcgaactcctgaccttaagtgatcctcccacctcagccttacaaagtcctgggataataggcgtgagccactgtgcccagctactttgcccagttctttaaggtggctgaagaaagtcatatcagctgccaataccaactagtacagtccctcgctaataaatataaatcacgtgcaagaatcatgaggtgtttgatgaaaatcaagaatataaaagagaaatgtaaaaataaatagagcaaaccctgggggggatggtaaaaattatattatatttatataaccaaaagatatactatgctatcacatccataaaataagaacaggctgctatgaaaaagaagtaaacaatgaatgagaaaacattcttggaactaagaacatgcaatgcaatagaatagctgattggtagaagggtatagaattgaaaaacaaatccacaatttaaagaccaagccatggaaatctggaatgaagagtaaaatacaaagaaaagcaaagaactaattcacagaaaagttggaaatatacagggtagagctggagagccaatattgattgaatataaatgcttaaaggaaaagaaaaaaacagataactgatgagagagtaacaaatacatcaacaaataaaaaggaagcaaaattcctagagctgaacatgtcttcagatttaagtaaactaatggttattacacagagggaatgcaaaaaggcctattccaagatacactgtgaaatttctgaactctaaagcgaaatcccacaaacttccataaaggggaaaaatctagagtggcacctaagaaccagactgtcagagtggaatcaggattagtaacttcacaccaaatgacagaaggcagtgaaacactgtttacatagtttctagggaaaaagatttttcacctagaattctatactttaccaattatgcagatgtgagggcaaactaaaattacctaaggacaaagatggtgaaggagtagggggaagagaaaggaagatggaggagaaacagaaaaatgagaaaacagttgaaaagtaagcagttgagcaaagaaaccaataaaatacatggctaaatctaagtaaaggttgataatgtgtctgtgatgcttaatatgactgctaaaaatgtattcctgaagtattttgatagaggcaaaatgttttttaaaaaatccaaccatctggaaaaatacaactaaaattcttttatagactttgttcaaggaaaaggatagaaataatgattaaatcataataaaatttatatgggtttgtcatgccaaactaatttaagtctctgggttttctataatcacatcatacacaaattaagataaacctgtttcttgaattgtttattaaacatttaatgatgaatattagaataatggaagtaggatgcaaccaccagaagggggaaaacaggaacaaaaataatttgaccaaatcagcaaaaatcaggaatgaaaaggaaagtataaacaaatagtaaacagagaatataaaacaatatagaaggaataagagcaaccaataattacaatacatacaaatgtgttaaattctactactaaaaaaccaagactctcaaactctcaaattgggttcacacacacacacacacacacacatttctgctctaaattctgcaagagccataatagaaacaaaacgacacaaaaatgttcagaataaaaggatgcataaatatatatcaagcaatattacaacatgaatataagaaatgcagagttcatgagaaattatacacacacacacacaaagcatttaatatatgtatttagttgtcatgaagagaatatatagaggttattatactacatatacagtgtatgtaatagacataatcatacatataaagccaattacccttgcaaatttaatactatttcatatgtatattaggtacaataaaggctatattaaatagttttaatttggtgaccttaatatgctctaggtagaacaaggaagtcattgcttgaaaggaaacagaggaacaggcggtggttcacgcctgtaatcccagcactctgggaggccgaggtgggcagatcacaaggtcaggagtttgagaccagcctggccaacatggtgaaaccccatctctactaaaaatacaaaaaaaaattagctgggcatggtggtgcatgccagcaatcccagctactcaggaggctgaggcaggagaatcactggaatccgggaggcagaggttgcagtgagccgagattgtaccactgtacttccagcctgggcgacagagcaagactctgtctcaaaaaaaacaaaaacaaaacaaaacaaaaaacagaggagtctggtagggaaagagataaaagatagctactgacagaaatgagaacaggagctactgggaaagtgatctacattattttcagtttaaatatgttcaatacagaccctaagtaaaattctggccaataaaaatcaaaagctgtgtttacaaaacaaaataccaaatcaggtttttaataatagaaaattgatgaatataataaattatatcaataagtcaaataaaaattatctcagtggcatctgaaaaagttatctaataaaattaaaaccaagagagatacaaatcttagctcaatttacaaaaaaatggttaatggaggcatacttactaaaaggaggtataaaacaaaggtcatcacaatcacgctatcattaccatatgttgtgatcaatgcactaaaatataaaacataaataaatgctacaaaatttgggaaggatgtgacaaaattgtaattaacagacaatatgattatatacctaaaaatatgaacaactgaaattagtagaaattaggttaagtagtcaaatacatgataaatatacatacagctttcacatataagaaattgccagtcagaaaacataatgaaaagcatattttgatcatactgccaactaaatatgtacaaaatctataccagatctgtattttaaaaaactacaaaaccttaatttcgaaaataggataattactcttcctgaaatagaaaactaacaaataaaacagagaaatagaagatgtacttatagatgtatgtgtctatttatctattcatcccttcagctagccatccttttaatcttatagtcacagaatgattctagaatgtggcttagctaatcttaatgacattatctaaattatgagatttgtgatggtttaactttcttcatgtaggtatttttctgcattatttataatgagcacatttcttttttctgaaataataaagagactgtggagaaaacctacataattaagataggaaagatttgaggttaaaaaaaacactctattttgttcttgaatagacagaataaatattatttaaatgtcagttattcttaaagtccacagtttgatacagttccaatcaaatgtccaaaaaaatttttttggtatctaaatttagtcaagaatactaaataagcaagaataacaaattttaaaaaggaaaattaggaggaaatgaaatgaaaagtgttataaagtactgtaacacagtaatagcacaagaaacaaacacatcaatgaacaacacagctcagatatagatgttaatataagtgactttcaaatttctggatgtgaaatagtttctgtaattttataagtgataaaataaatttcaaagaaaaagaccaacaaatcaaagttaatacgaatatgccacaaacacaaaaatttgaatttctatagataaataataaaaaaaattataggcaaacaacaaactagagaattctgtgatatgaatctgaaagatggagggctaatatcattacaaaagatctctttaagacaattaagaaaatcattaaggaaacatacagataagtgaaaaccataaatgaggaattacagttaatgaacatattagtaaatgtttaaccattctctataataaaaaaaaatgcaaactcaaagtgaaagactattttgtccattatgttactaagttttttgttgttttgacaaactcaattctattgatggtattttgcaacaggctctcatttcttactggtgcagatataaattagacaataatttgacaaatatgaatctagaaccttaaaatgttcacaacctctggctttatagtaattccatttctggtaatctgtcctaggaaaataaactaaaataaaggattatctttacatgcaaaaatgtttactgcaattttttatcataaaaaactgagaaatatctaatctaacagagggaaataattaaattgtgatatacccagttgatggaacattagcatatgtcacagattttttaaacttttaaactttttacaattattttacattttaacattttcaaagcttaggtgtgtcttacaattgttggtgccttacactaacaggcagattcttttctttctcggttgtacataaagtaaccatatgtcttaaaaccagcgacttattaaatttgatgaaatatgtctaggaaaatatttccaaagaatgtgaaatagaatggaaatgttaatgttaaaaacaacatcccaaattacagagcataactacaactatgtaaagcaaacaaaaacacaaacacacaaaacctatgtatagaaaaaataattttgaaatgttaacggtgattgcctctgagtaatgtagtttgcttgtggatgcttaatttccttctttcttcaaatgttctgttttttccgaagcttgtataatagatcatgcaaatgcttttatagtagaaatgtctctcttaaatggtattttgaatgaataaacaaataaccttttttttttaagttcaaactgtggaatatctgattgtcatgtcttttctttcttttttttttttttctgagacggagtctcactctattgcctaggctggagtgcaatggcatgatctcggctcactgcaacctccgccccccgggttcaagcgattctcctgcctcagcctcccgagtagctgggattacaggcactcaccaccacgttcggctatttttgtattttagtagagacagggttttaccatgttggccaggctggtctggaactcctgaccttgtgatctgcctgcctcagcctctcaaagtgctgggattacaggcatgagccaccacgcctggcctgtcatgtcttttcaaagcattattcaaacatgatttctttggctataaagtttcataaagagtagtacttggctcagattctggagagaaagccaaaaaagatcatccaactctgctcccagggaactcacaccctgtagattttgtagtagattttggcagcattctctttcctaatacacagtaaaatatttcatattcctaacttgtgtgtgagcaccattgaagatggcccaaaatcaaccacccaattgagtcatctgaatatgttcagtgacataaatggaaaggagagttggcagggggcaggggggtaggagaggacctaggggaagaggggaatagccacttggagcattaaatgcccttgttgttatcccacttaaaatatttcaaagggaaaaatgtctaatatctaatctctaactatgctattcaataataatttgaggccaggtgcggtagctcacacctgtaatcctaacactttgggaggtcaaggctgcagtgagccatgtttgtgccactgcactccagcctgggcaacacagtgagactctgtctcaaaaaaaaaaacttaaaaaaataacattttgaatgtcaaagttttcccaggaaaactgaagggagtgggaaatttatatctgaagccaaaagagatgtctcaacatttccagaggtataaccaaactgctaactcattttaagaaagacaactaaaaaatgaaccttcttttcctcacataagtttattttacaatcaacaatgagttagacaggaacatttccaaaatgatttcttaagagcttgttaatttaacttaaggcacaggcaccttctgttaaactaaaaaaattaaaataaacctaccaccacataaaaaaaaatttcagggccaggcgcggtggctcacacctggaatcccagcactttgcggggctaaggtgggtggatcacatgaggtcaggagattgagaccagcctagccaacatggtgaaacctcgtctctactaaaatacaaaaattagccgggtgtggtggcaggcgcctgtaatcccagctactcaggagggtgaggcaggagaatcacttgaacccagaaggcggaggttgcagtgagccaagatcgcaccactgcactccagcctgggtgatatagcgagattccatctcaaaaaaacaaaaaaaaaattcagaaaaggtcagggatgctattcctttacctgtattccaaataggattcacagatagaaagaaatgaaatcaagtgtacatggcaaaaaattgtgcctgtaagattcattttttaaaattaaatgggatggaggttacatgagtacatacatatgtcaatactaattgaaccattctcctaaaatgggtgcatttgattatatgaaaatcttaaaacaaaaaagtgcaccttaaagttctactgtatttgctactgtatccaagaagactctcccccaaaaaacataatttagaattgccttcacagagatggttaagttacaaagcatatcattatatatgtaataataccatatcattatgaaccatattatatatgtcaaagaatcttccaatcagtatcttctatgcttcaatttttccattttaaaatatgcatcctaaatgtaattacaaagcaccacaactgaattttgtacttgaaaacctatagatatgagtgaaacaataaagtataaataacaactttcactgacaatccctttttcagttaaaaatgactaagaataacttgtttttataagttttattaaccaaatttgagggagaggcactttctaaaaatgggcaatttacacagaaatggaaaagttgtgaggagctttttatgagtcccattcatctggaagcctcagtcagacttacatcagaagaaaaactcttttataagagaaactcatgtcccttgttaattactctttatttctaatgtacagtaacactgaaatacatttttaaaaataattaacatataaagttaggaatatatacaactactactacatttattatctaaggatcctactaggctattgtagttccagaaaaaaaaactagtaactttattcattacgttcacactgatgtttctgttgacagctccagtcatttgtcagagctaaaattttccacctttattagctattaataattgtcaatgattgaaaattttatattagaattttacaatctcaacttatagcagcgatctgaaccaaagtcagtattctcaaaaactggtaactatcattaaagcattagatcttactgaaattaacaaatggttactctttaaaaaacagaattatcaagggagactcataattcagttttcattctttcttgtaagcacatacatattacacataacaaattttggttagttactgttattgatattaagacatggtttatacaaatagtgtgaaatacaactatttcatagcttcagtaagccctgtgcctgtctatgacctgtcaatctataaaaacattaacatgagagaatagagatgaaagtgattttgctaaagttatctgttatccccaagctgttcaaagttgattcggtttttctggctgagtaatttgatataatctttcatccttccaaagttggaagggactatatgagtttctgctagaagtttgagacatttaagtcacaaaactgcaaagtatgttatctcacttataagcagtaaagatctctgtttaaactaattaattagtgaaataccaactttgactataattaatagacatgctaatatagttttaatagatttttctttgttatgtgactatcagctaaatataatctttaagccacattacgaatatatatgtgcatgtaaacacagtcatatatatatcccagaaatggaaaattgtccaaatctacctgtatccattcagtaaatacttgttaagaacctattatataccatttaggaccactcaaaatcattactttttacataagatttacaatagactaaagaaagtatttcttgatcaaatgcaagagtttttacgccattacaaatcatccaagataaccaaaacctgcatctactgtattgtttatttcattattatttcattacatatgcatattgcattactgacttttaaatttcatatactggcaattcacagagactttcaggaccagtaaagttaacttggatagacccaagacaagttttccaaataagtcacatttcttcatatgggtcctagtaaacatttgcaaatacataatccttctgagttaaagttgacacctgactttagaatgtcccatgtactcaagatacctaaccttgtaaattgcctcccctcagcaccattcctactcattcaaggcagcaaccaagttataccatggtcttttcttgttctcttcagagttagacctattctatcttacttttgctttgttcacatctcacaattcagtcaattcttttcaggccatctctttctcataaggaaaaacgtgtgcccctaagcctctttcctttattggatatcttggaaaataacccatttcaatttttgtgaaccaaagaaacagtttagtcctcatgcaataactattatcaggtacctactatgtgccacacactgggctagacccttaggaatggctaagtacaaactcaatggccagaaatattcttgtagcaagaaaaagagaaatcactgatttcaatgtcagattagatctcaaaaacagtgcaatcaaccttgaaagctcatgaaagcacccagaaaacccataagcatccttccaaatacctatccacctattaaacttgcttttctttaagcattcatatttagaataaaaataatatcttatccaacataattattttatatttagtttcgtcattggaattgactttcttatatttttcaaggtagcaatggtttttctacagcatgggtaaaatacatgcttagactataataaacgcccaacagtcacttgataaactgtttcccagggaaaatgggttctaaatttccaacaacccattcacaagtaaacttctcaaatacaaagtgtttgtaaattgggaatgcattattctttatttctatatttacattcctatgggcctgggaaatggtaccatcactaaggtaacacagtgaatgattagtttaaaataaaaaattattctgaagagtgtgaagctgtatgcaaataattttccaccagtctaagaaggactgagcatgggaaaatctataaagaagtaaaagtaagtttgtgatattatctctatgatgtttacttttaagtgcaagatactaactagcccagaaaaggttcccacagaccagttgagctgcttcttatacataggtcaacagtctaaaaaaaaaattaaaacctgcaaaatcccacaaaacaaaacctgttttacaggcttctgtacacgtagaggaaatgttagagaaattacagccattttatggtctatctagggtacaagcccttctaatgtgtttactgatactctgcagaagttttcatttcagttgttttgccttaaaggattcacttgaatcaataactaaagacatatatattttttgaggctagcagagggtagattagaaactctgcttagagtggtgtatcctcatgcagtgactcaatttcacagttaacaacatacactttcttcctcctacagaacaatgattacatgcctccctccatgcctttaaaaagatatatataattggcatacactctcctattttaagattatacaaaaaaagttttattggaatgtgaatagatatttttaagagtttatttttctttgctctattgcttatacaaacacaaacacacacacacacacacacacacacacacacacatggttatattagctcttcaacagaataagattatacgagaggaaagcttggtataaactgtaagaacaaaataactgctttattccttacttagaaacccaaatgcattcattcattttacataaagtaggaaaaatcaggtgtcacttattgggtctaaaagaagcagtcaacatttaaattatatatcctttgaagtaacagtatcaacatttttatttaaattatgagagaatgctgtaatttataatacaaaacagtgataattcaaaatttactaacaatagacagaaagagataactttctaattttcatgcagttgaaagagaaacatgaaaaaaggtatactgtactgccactattttatttttggaaactctttgtaaataaaaacccatttccaaaataagatattccatgaacacagaatagttggtaatggttcaagtgccttaggcaacagagaagtattgttttgtagtttttttaaacctctcctagtaacagcaattcattatgcacaaagaaacaaggtaacagcatggtttataatgcatatataagtaataactgcagaacctcaattaaaactaaagtttaccatattccttccatttctataaaccagtatagataaccttgttgatactcaccaaatgttacagaaatgcctaggcttttctaagcaacaaaatgtagacacatggtgaggtgctgaagacagctctttcttgagctcaaagcactttagatgaagtagcctttatcgtccatttaatagaggttgcctcctattaccaagcgtggcagagaaaagagtttccacaattaggtcttgactttctgtccctctttttgaagagtaacagttaccactggaaaacgttaccagaaaatgatcacttgaacactcacatagggcagctgtaaatttccactctctttgcttgctctcagattccaagccttgcttgtctcttaatctgtcacaggcagttctgtttctggtcaaaccagcttgcttatgcgttctccactccctctctaacacttgctttcagatacgtaccacagtcacagctcccttttacttcctccctcctcagtcctgtaacgtcacaagaatgcgtgtaaagctgaggcaaaataaattcttgggccaaaaaagaaaaaagtctagagataaacaaaattttttctcatcacttttttctgtcttaagtcttatacttgttcatgcatggggttttgtcaactgattaaactggctggaccaccttgtttaaaaatgtaaataaaggttatttttaaaaaagtcatgttgatagtaataataacagattcacctgctaatatgctagctcctgaaggaagatgctattcccaaccataagaaagtggagcaagtaaacacacaagtacttgtattagaaacttaatcttaacatttaaaaagcaaggaaggttttagagtacttataatttaaactgtgcaattttatgaaaaaaatgtatttcttaatacggtatattttgaaacttggaccaaaatttgcagttataaaagggaaaattataaagaacatagaaaaatattgacaccaaaaacaaaagagcagtttaatcatgtatgtgcaaaccaaatgtaattattgctgttggaaagaaggttttttttccccctaaacattaccggtcagaatgcataacacctcttataagaattacaaagtctaaaggctacaaaaaattattaaagtgattatacacatacaattatagagtaaagtatcttaaaattacgaaactctctgtaaggtttggggatgaggaattaggtagaaagctgagtgggctcgtggttggcaggtttagatggcatttgtaggattctttggaattaggaggcaatgtatgcagcttggaatacgtgctggctctgtatgaatgctagtcagatcctgctttggagttctgttccagttccttagcccagaacacttttaggttctccatctcccactatgtccccagtcaaaagtcttgggcccttctactgacggatcttccaagtacagaaggaacagaagtagttattagacctattattaagtaacacattcttattctctgcagaattaaaatctctctaagaatataagcttaagtaaggtgaaaggtaaacatctataaacagttgtttatatcccttaagaaaaataagtcagtaaaagtcggccttaaaatataggtgttttgatctcgtttatttaaagtagaattaaaatttaactatattatacagttatttggttatttcttagcacctattaaataggtatcaaagacgactagagattagtctgccaatttttctttcaattagtagttttataatttttagagttttatttctcctttttaaagagatgttaaatggaaataattctaaatcactgagggtatgaagtgtctagtaccttaggttatactccgagagttgtagtataattaaagaaattcagaatttataaaagtggttcttaggataactgcaaggttaatttaaaactgggagactgtatatcaatctatagtggattcaaaggcacaaagtcaagtcaaggactttaaaacatataattactaagattatttatgattgtttgtatatttaattcctattaaataccattccattttccaacagcaagagtgcagaaatctcataatatacaggaaactgggttgagtattcagaaggatattgcctcagtagcggaaccaaattagttttagattaaaggttgttctggtccctcttaatagagattaaaagtaagccccgaaaggatcgaattacttccaaataactgcaacccagagtaaaattttaaaatatttatataaattttttaaaatctagcacacaataacgtaaaattcacaatatctgacatccagtcaaaaatcaccaggcatgcaaagaagcaggaaaacataatgcataaggagaaaatcgatcattagaaaaagactcagaaatgacacaaataatagaattagtatacaaagacattaaaactattaaaaatatcttccataggttcaagaaggtattagaaagataagaatgttaaggagagacatggcagatataaaaaagatctacatcagatttctaagaattaaaattacaatttctgagaaaacatttattctgtttcatggaatgaagtgttgcctaactctagaatcacaaataaggccaactaagatctttaaacaacagcaacaacaacaaaaaaaccctataaactctggaatgaaaattacaccaaatgagatgaatagcagactgcacaccgcagaagaaatgattagtaaacctggagacacagtgacagaacttatcaaaataaagcattgagagaaaaaaagtttaaaaaaataaaaatgaacagagaatccctgaactatggggaaacttaaaagaacctaatgtatactatatatactatatttagtctttggaccttgaataaacatcagcagtagccaagaaatagttgttacaggccttgggcataacccagtactgtgctggcttcacgtgtgacccagcattgacgcagtatagtcctagcagtggtggtcacaagagggcttgcaccatccctccccgaactgtaggcagctcagcaaggagagacagagaaagactcagtaagggaagagaacacgagactgtctggtaatccagggaattctcctggatcttacccaagaccaccaaggcagtatctcctcaagtctgcaagtcacaacattactgggctttgaatatcgcctaatgcaaatttggctgcagtgaccaaagacttagatcacaacactcaattccctttgaatatctggaaagccttctcaaaaaggacagatacattcatccttgagaggtctggaaaaaaaaaaaaaagacaagtacaaataagctcggagtgtgaagattagaataaatacctaactcttcaatgcccagacaatgacaaacatccagaagcatcaagaccatccaggaaattatgacctcaccaaaccaactaaataaggaaccagtgaccaattctggaatgacagagatatgcgacctttaagagaattcaaaatagctgttttgaggaagctcaaagaaatccaggataatacatagaaggaattcagaatcttatcagataatataacaaagagactgaaataattaagaatcaagcagaaattctggagctgaaaaatttaattgacaaactgaaaaatgcatcagagtttctcaaaagcagaattgatcaagcagcagaaagaattagtgagcttgaagacagactatctgaaatacacagagcagtcaaaagaaaaaagaataaaaataatgtagcatgcctacaggatctagaaaatagcctcaaaatggcaaatctaagagtcattggccttaaaaaggaggtagagagagagatcggggtagagagtttattcaaagagatagcagagaacttcccaaatgtagagaaagatatcaatattcaagtatgagaaggttatagaacactaagcagattttacccccaaaaaactacctcaggacatctaatactcaaacaatgaaaggtcaaggataaagaaagatcctaaaagcagcaagagaaaagaaaagaataacatataaaggagccccaacacatctggcaacagatttctcagtggaaacatcacaggccaggaaagagcagtaagacatatttgaaggtctgaaagaaaaaaaccttttatcctgaaatattatatccagtgaaaatatccttcaaacatgaaggagaaataaagacattcccagacaaacaaaagctgagggatttcatcaacccagacctgtcctacaagaaatgctaaagggagttcttcagtctgaaagaaaaggacattaaggtacaataagaatcatctggtcatctgggccaggcacggtagctcacatctgtaatcccagcactttgggaggctgagacaggaggattgcttgagcagagaagttcaagaccagcctgaataacatagcaagacctcatctctacaaaaaatcaaaattagccagaattgctggcacatgattgaaccactgcactccagcctgggtgacagagcaagaccctgctgaaagaaagaaagaaagaaagagagagaggaaggaaggaaggaaggaaggaaggaagggagggagggacggagggacagagggagggagggagggaggagggagggacatatactcaatggaataatattcagctataaaaaagaatgagatcctgtcatttgaaacaacatggatagaactggaggacattatgttaagtgaaataagccaggcacagaaagacaaacttcacatgttctcattcatttgtgggagttaaaaatttaaacaattgaactcacagagatagagaggagaatgatggtggcaggaagcagggcaaaggggatagttaatccactaatgggatgagtataaaaatatagtttaatacaatgaataagatctagtatttgatagcacaacaggatgactacagttagcaataatttgttgtacattttagaataactgagggaatacaattggaatgctcttttttttttttttttgagatggagtcttgctctgtcacccaggctggagtgcagtggcgtgatcttggctcactgcaagctccgcctcccaggttcacgccattctcctgcctcagcttcccaagtagctgagattacaggcatccgccaccatgcccagctattttttttttttttttttttgtatttttagtagagacagggtttcaccatgttagccaggatggtctcgatctcctgacctcttgatccgcctacctcggcctcccaaagcactgggattacaggtgtgagccactgcacccagcctggaatgttcttaacacaaaaaattgacgaatagttgagatgattggataccctatttaccctgaggtgattattacacattgcatgcctatatcaaaatatctcatgtatcctataaatatatacacctactatgtaccctaaaaattaaaattttgaaaattaaaaagacaacaccttaattgaaaaaaaagtcactccaaaaaaatagtttgttttgatgcttttaattctaatctatcattacagaattttaactctactgctttgctcttatattcaccttcacttataccacaaatctttgttctaataacacagtaacataatgatatatttgcctactctttcaatatgtctaatatagattcaaaataacagtaccaaaattactaaaaataaaatcactgaatgaagtttaaagaattctttgccgttaactaatgaagtggtcagcatataactgtcagtagtgagtcctaatgttaaaatttaattattttacgtgttataaaaacaaaactattttacattgttattcacaattgaaagaaatttcataaaacaagatttcaatttctttaagtagagactttaacaacctataaatggtgtagttcaatggagttgtctcaactattaagaaaatcacaggaagaaaaaattaaatgatgtatatagatcaagttacagtcaaatggcatcatggcatgctaaatatgcaatgattctacagttatttgaatacaaaaaaatggtaggaaaattatttatcacttaaatgtggtagctttggtagcttaactatgcagaattccaagttacctcctccacctcagcagtcatatttacattattgagtgttgtaaggctttgaatccatcttggcatactcgtactataacaattcactagcaataagtcctataactagccaatgaatgtttaaggtacattattgaattgattagtccattaaattaaaacattagtggttaaaaaagagttcattgtcaacaataaaaacaatggcacaaaacctggtttgtcatgatccccccccaaaaaaatcaagactctaacatgtaaaatactcaatacacaaatacataattatatgattaagtgccacctccacaatttagtgctatattttgaattaaataatattaattttactttattggttttacagttatttatatttaattaacatatttgtttttatttaaatatataacagttgtaagaaaaagtgtattaaggccaaggcccagtggctcatgtctgtattcccagcccttatgggaggctgaggcaggtggattgcttgagcccaggagttcaagaccagcctgagcaacatagcaagaccccgtctcaaaaaaaaaaaaaaaaatagaagaaacaaaaatttagtatgccagaagcaaatgctatgtgaatgataatagtataaaaaaactagaaatccaggttgcggtcagattatggagagacggagtgctagacaaaagagctaaataatttgcggacaaaacaggccatgatcagaactttctgtaatgaatgtgaatttggcagaagaatcaaagggcaaagaaacagtaggtgatgaaattaaaggtaactcagtagtctaggatgacagtgagggtaaccagacagtgggaataaaaggactacaagagtataatagagaataggtttggcaactgaaaaaatatggatagtaattgagagacgagtcaagatcacaaggcattcccatgcctgtgtgacagtaagcaggttatacctttaaaacatataggaaccacaggaagaaaaataaattttatgaaatagccagttagttgatatataacaagtccgagatgccagcaaggcttctggatataaatgcccacaggcagctgaacatacagaactagaacttggagagaaaacagactggagcaatatatctgggggtcatccatcctgccactgcagtacgagagagaccaaaaagagagccaaggacaaaacttcaagaaacatctacaggtgttggtagaaaaagggcaactggctgggcgtagtggctcacccctgtaatctcagcactctgggaggcagatcacttaagcccagaagttcaagaccagcctggacaacatggcaagacccccatctctaccaaaaaaatacatacaaaaattagttgggtgtggtggtacactcttgtggtcccagctactcgaggggttgagctgggagggtcatttgagccctggaggcagaggttgcagtgagctgagattgcaccaccgcactccagcctgggcaacagagtgagaccctgtcccctcccccccaaaaaaaggcaactaaataaacagtggttagagagggagaggagaaactgaaaagtatgttatcgtgtgaccaaaaaaacccagaccttcaagaaaaagaagcatttaaaagtacttactacctaaccctgtagtctaatttctaagtcccactttcaattcttacaaagcaaaggtattagtgggaaaggggcctttagagaaccacttggcccagagaaagggacttttaagaattcatattccctaaattgctaaagacataggctggtagtcagcgagacaaaagacaggcagggaccatcagagcatacagcagtacagcaaagcatgaggcaggcagaggactccaggccagcccttccgggaaactggtaacactggctctgattcaggcagcatgcataacccaactctgccatgccatgcctagaacactgtatgggagattggagacttagtagtacctgacacaacaataggattaggattataagaggttaggaatgaggtaatagagaaatgaacgtatattactgtttccaagtgttggatataaagactagaaggacagcttgaagggcttaataaaagaggtttttgtttgctttaaaaaaaaaaaaaaaacctttcaactcttggtagattgagtgggacagacaggaggaaggtagaagatgagaaagggataattaatggggcatgatctttgagcccacaatgggagggatcaagaacataagtggaataatatatatttttctaaaatgagaaggaggagaaagcattagtagagactgcccagggaaagaggaatgaagttaggaagcacaggtttacttcaattttctcagaaaagcaggactcaccatcatctgaagagaacaaaggtagagtaaaagaatatgtgtttgagcagagtgaaaattggtcttatcagaaaacccacatgtggctgggcacagtggctcatgcctgtaatcctaagcagtctggcaggaagtaggaggatcccttgagtccaggagttcaagaccagcctgggcaacatagggagaccctctctctatttaaaaaaaaaaaaaaaatccacataaatacagtaagaagaaaagctaaaaggtgtgactcatgtacaccaaatcctaagtttaacagttaaagttccgcttatatccacacaattccacttatatctaaacaatataacaacgctaagtacatgctatgcttttccaccaactgcccaatttaaggaataacaaaggatgaggttaagaaacagatcttggagccccaagattcgatatacagctagtatcataacaacaaaatgggcttagtgccataaccacaggcagatggtgatactaataattctcatatttccctgtccttctttgctggatccatgttctgttttctccacaactggtacgcttatgaaaagttcttgctcaagtcagttaagaacataagataccttttagtaaaagaacaattcccaccctgttgagaactgatgtacattctctttttatgaggtgtgtcatactccaattttccaagtttttacaaattttcacttttctacaaattattgaaaccagaactatacaaaaattttatgttggagaatcatattattactgttataaatctttaaaagtacaacttgtaagctggtgctctgaagccaagaagaaaaacaggatctaaagagaacacagaaagaaaggacaaagaaagaagcaggctgagtgaagggacagaaaaccttgagttataaataacttggtttaaaatgtcaagagaaactagtctcaaagtatctctttctacagagttataatgctttttaataatgaaagtacttcacatgacaattttcaaagtcaaagccatttatggcaaacaaacacatagcatttgcaatataacatattcaggtaatttactgaatggaaaaatctctatggaattcatccagtaattatagtgggttccatttataaaacatattttaccacaaatctgaagacttataaaacatgatctagtataggagaaatgattataatcctttaataactattaatcacagaacaattagttttaataactataaccacagaatggcatcttgttttacaaataaaatacaaaccagtgcactgttctagctgtactcattctaaacatgtctttttatcttttaattttaaattaaatgtccattaaaaaagtattttttattttctatgcttctctattgttttaaaatcccagcccggtgtggtgacttgtgtctgtaatcccagcactttgggaggctgaggctggtggattgcttgagtccaggagtttgagaccagcctgggcaacatagtgagacctcgtctctatcaaaaatacaaaatatcagctgggcatggcggtgtgtgcctgtaatcccagctacttaggaggctgaggtaggagaatctcttgagccttggaggcggaggttgcagtgagccgagataacgtcactgcactccagcctgggcaacagagagagactctcctgagaaaaaaaaaaaaaaaaagaaaatcccccacctccctcttctctaattcccctccccaagattaagcactattcaaagtgctatccttccagaccctttttccaggcatacgtagatgtatgtatttgtttgaatacacaccaagataattttttaaatgagataatactatacacactgcattataatttattttatttctttatagtagatcttggatttctctacatttggtagctctatctcattcttttaaaagtgttgcatggttgcacagtagatgcacttggcactgaaaactcgacttaagtatatcccgaggatgaccctgaatgtggttcacagttttgagctaaggaatctgggataagctggagacccattccttatctatgaggaacattcgagcccccagcctggctcatggaacacagggcatagaagggatcgaggtcctttgttttgggttaaatgaaggttaccaggtggaggttgttagggagaaggcattaagtgaaaatgctatgtaaactgcatgactgttgcaagcagttggttctcttgcctagcccactgccactggactctcttccctgtatgtaaactccccccaaaaccctctgtctcctttgctggctctgggtctccttggcctctagaacctggtgccatccccactggagttgataggggttcagcacaaattggtgttccttaatattgctgtactacagtttgtttaaccacttctctatatatagacatacaggtaggtgagggtgttgttttttgtttttgttttgctatcttataatctattttaaaattagtcactgataacataaacaaatcagaatttaaaaacacaatgttaattctccttggaaaaaaagccataaagtgattatttgtattattctaataatacagataaataaaatttacctttgccatttaaaaaaaaaaaaatggcaaaaaccacaattacttttgcaccaacctaataataagcatttttttcattttaaatattttggtttctcacagttgataaacatgcaaaatctgtcattgttttcaatacaatgttatcaataattctgaaaatttacacatgcaactcattttcaaattaactgcacattatggcctttggatatgcattggatacccaatgtgtttgagggctaaatctcactaattctccactattactcaattacgttaagccagcagtccccaacctttttcgcaccagaggatggttttgtggaaagccattcttccacggacctggaggttgggatgcaggggatggtttcgggatgaaactgttgcatctcaggtcatcaggcattagagtctcataaggagcctgcaacctagatccctcacatgcacagttcacagaagggtttgtgctgtctatgagactctaattctgccactgatctaacaggaggcggaattcagatggtaatgcttgccagccagccactcacctcctactgtgctgcccggttcctaacaggccatggacaggtacaggtctgcagcccaggggtaagggacccctgcattaagcaactcttgattggtgttttcagaagcctagtgtgatactaggttctctaaggaattcaaaagaggtctgtgataaaagatctgtcttcaaggagcttgtacaacttttgtgaaaacaaaacaaaacaaaacaaaacaaaaaaccttagctatctatataaaatcattacacctgaatacaaagttttgaagaaaatacaaaaggaagaagaaatatgcaagggaccaaggtatattttaccgtattttatcataaggtaaaatatagagattacctaagtgaggaaagaaaaggagtaagtgaaagaaatgggacttttttaattgtacaaaaatcatagactttataaattcttctaaaacaacatatttcctgaggatttgttagcaaatacctaagaaatgggaatttagatgcactttgaaaaagtactaggatttggatatagtgagatagaaaaaggaacaatatcccagcataggaaaattttttagcaaaaatgcaaagactggaatgaaagtagaaaagggacggaaagagaggtagggaaatgggagaaaagaaaattgtggttaaaagggaaatacatagggaagtttttgaggtggagtggtggacagggagggcacatatatttgttgtcaaaggaagaagcctggagagaggtaaaaagctattccctgtacacttggcccaacacgttttggtcccatttcaaccaatactcacccttttaactggcttctacaagaaatccagatacaccaagtatttcctggcttttgtaagtttttatatgtgaggtcacagtgaagtgtcacaatacacgacatagcatttctccagagttcctattcctttcctgctggattttccctgtgcctttcaagtttttcttcccttttttaaacagaaaatttaaactctatctcttctagttccaaatatgtattcctaactcatcctaaactgcaacaaaacagagactcttccaacggcaaggacatacctccttaaaaggcaatttaacaaccgtctccaaatacttgaacaaaccctttgtggagtcaacattcatcacaaatgaattatccatgcttttcttccaaacaaattctgcattttctatacaattcttaatgcttactaaaagattaacaatttctccattgggatagagtcaaaactgcagatgaaagatttgccttagtaaaaagaagcataatgttataaaaaatgaatcattcttttcaagaaatagaggcagcaacagttcttaaaattaaataagaactagaagaatgtagtgagacagaatcttgtatactgctgagtagaacaaaatccccaggaacctttctagaaaacaatttaccagaatattcatgctttttaacatatcaattctactaacaaaaagctatcctgagaaaatagagatggctagatggtaaatgatgttattgcaatgttatttacaaaggaaagccaagagtatctacaaaagggaaacagttgaataaattatgttatgctaccatcttagaatattatagacatataaaaatattttaagtgccatatatagtcacataataaaatatgttaaataaaaatcaagaaataggactaatacttcaaattcattttaaaatcataaatattatatatatacaactatgtgtgtgtgtacagagacatgcataattttatatagataaaagactagaaggaaatacaacaaaattttaacagtaattttctctgggtagtaagactacagattacttttttcttctttataattttctgtaacaatcaaattttctacaatagcatttataagtggaaaatttgttttaaaaaaggagcagctttgtttcgccattaagtaggcattaaaaaaaaatgtaggcttgctgggcacggtggctcatgcctttaatcccagcactttgggaggccgaggtggaggtggatcacttgaggtcaggcgttcgagaccagcctggccaacatggtgaaatcccatctctactaaaaatacaaaaagttagctgggtgtggtggtgcgtgcctgtggtcctagctacttgggacgctgaggtgggagaatcactgaagcctgggaagtcgaggctgcagttagccaagatcatgccactgcactccagtctgggcaacacagtgagaccctgtctctagaaattttaaaaataaaaataaaaaataaaaaatgtggccaggcgcggtggctcacacctgtaatcccagcactttgggaagctgaggtgggtggatcatgaggtcaagagttcaagaccagcctggccaatatggtgaaaccccttctctactaaaaaaaaaaatacaaaaattagcggggtgtggtggtacacacctgtaatcccagctactcaggaggctgaggcaggagaatcacttgaatctgggaggcagaggctgcagtgagccaagatcgtgccactgcactccagtctgggtgacagagcaagactctgtcttggaaaaaaaaaaaattaaattaaaataaaattaaaaatgtgggctctgatatatttatgatctatacactctacactatggtactggtgaagcctatagacttctgagtttccattataaccccatgttgagtaaagttttaagggcacaggaagggtgctgatttggacctcatacagaacaactttagtgacactagaatgtgagctttgtgagggcaggatgttggtgtgttttgctcactgcttcatcctcagcacctaaaataatgctttgtacacggtaggcactcaacaaatatttgttaataaatctccaactaattttttaaaaattataaattactttcctgttttctactatgccttttgtctctaatcataaggaaaaacagagaggaagtgctgacttttagatgatgagtggggaagctcataaagacagaactggagttttttggttttcattgtgttttttgtcctacaaagcaaataatgctttctctcagaaagaagctcactcaggcttactctgacatgttcaactttactactgactttcctaacaagcaaagagcatttatgctgaaccacatcttctggaaagtcttgcttttaccccaactgtctcactgttcatggatggggaggtgcaactaaactgggttgtagtgaggacagaacatgtcactctgttactggctttagaaaaagtagagccagtggcctatgattccaaatagaagaactattgcccttctacagaatgtgctttcaaaccttgcccctgacccacaacaaaaaatacggctaacacaaaaaccccagtaacaagctaacatgtgtgcaagtaaagcaaaagtttcacaaaacaactgctcttaccacatctgatgcagtctgatattgtctatgctattcaatttaatatttttaaactgtggattacagctcagcaaactgattttatgacctactagtgagtggaaagccacagtttgaacaatgctgacaaggagacagtgctttcttcccctggacctgtaggcactatgtaacggagtatctagtcatgaagaaaactggctctggagcctcctacctgacttcacgtactgcctctgcaacttacaaggtgcctggacaaattacttaacctctctgggcccctatttcctcatatgtaaaatggaaataacatacctatgtcataggattattataaggattaaatgaattaatgtataaagtactcagaatagtgcctggtacacagtgagcactgtataaatattagctaagattattattattaatgtgcctactgaggaggaaaaacacacactgagaattaggtaagatgtaagagaaggtcaagaggtcctacgtatcctgatgctcttgttagaagcagaaaaagaaaactgataatctcaaaatcttctacatagaaccaagcaaatgttagtctatagtaatttggtgtttctctttgatgcctaaatagatatttgaattagatctcacagtttatgttggcatctaaaatctcactggctcttatctgaacccaatccactcctgattaagataatggttggatagtaatccattcctgattagtgttgaatagttaattttgagatagtgggcactttatattccaatttttaaaatagccttattgagatatcatttacataccacaaaatttcattatttgagtataccagccaatgattttaggggattgaggagagttgtgtaatcaacgctgcaattcaatttcagaacacttcctttactcctatttgtatcatctgcctacttgcagtctgcctattttaaatgaggaaaacaatcatgcattgccaggccatccaaaaaccccaactaattcccgcaaatatgactaacatacccaacttaactatttaacactactgtaccagatagaaattacattttccttctacagtgaagccaacatgtcctgtaatgtaaataaacaatagaataatatgttaacgatattaaaaatattatctaaattggactcaggcacctggcagaagcaaataacagaagcaaataacggaagcaaaaaccttcagggaaaggaaagagaaaataacaataaaatacacctttgggagcttaagaggatggggatattctatcaggggaagactgaaataaaactgtaatagcctcttatgttttccccaagaagttttcagcagtgcttacaggcagaattcttatcccatgttttcaatccagaaattaaaatctgagttaaaaaaaaccctgcaagtcattatgctaaatattcagaaagtgagaatacccactagggatggctataatgaaaaagacatactaagcactggcaaaaatgtagagaaactggaactctcaaacattgctggtaaaaatgtaaaatggagcagctgctttagaagcaggtcaatagttcctcagaaattaaacacagccaccgtatgacccagcaatcccactcctaggtttatatccaagagaaatgaaaacatacacccatacaaaaacttatacatgaatgttcaaagcagcattatccataataccccaaaagtagaaaaaaaaatgtccattaactgctgaatggataaatgtggtacattcataaaatggaacattatttggcaaaaaaaggaatgaagtcctgatacataatacaatatgggtgaaaacactatgctaagaagccagtctcaaaaggtcacatattgtatgattccattcatataaaatgtccagaataggcaaatccagagacataaaataggttcatagttgtctagagttaggagggttgagaggaaaggggaagtgactgctaagggttacagagctgctttgcaggaagatgaaagggttctaaaataattgtgaggatagttacacaactctgtgaacatactaaaaactactgacttgtacacttcaatgggtgttctagaattctaggatacattaattctatctcaataaagcaaacacattttgtttatttatttttttgagacacagtctcgctcttgtcacccaggctaaagtgcagtggcatgatctcaactcactgcaaccttcccctcctaggttcaagcgattcttctgcctcctgagtagctgggattacaggcatgtgcaaccatgcccggctaattgtagttttagtacagcccggggtttcaccatgttggccaggctggtctcaaactcctgacctcaagtgatctactcacctagacctcctaaagtgctggaattacagacatgagccaccacgcccagccaagcaaacatattttaaaagcatcattttgccatgtgctttttactctttcacctcatgtatatttgaaaagaaccttatgtttttaattaatttacattttattcatcaaaatgttttgttttttgagatggagtctcactctgttgcccatgctgggtgcagtggtgcgatctcggctcactgccacctctccctcccaggttcaagtgattctcttgcctcatcttcctgagtagctgtgattacaggtgcatgccaccatgcctggctaatttttgtatttttagtagagacgcagtttcaccatgttagccaggctggtctcgaactcctgacctcaagtgatccacccgcctcggcctcccaaagtgctgggattacaggcgtgaaccacccttagtcatcaaaatattttcaaagaactattcgataaatatcaagtctttcaaaagttcttcaaaagcttattttcctcctttgaatcataaagttctattccactaaaaaatatgaaattccagcctgagcaacatggcaaaaccctgtctctcaaaaaaatacaaaaattagccacatgtggtggcatatgcctgtagtcccagctgctcagaggactgaggtgggcggactgcttgagcccgggaggtcaaggctgcagtgagtcaagatcataccactgcactgcagcctgggcaacagagagaaaagaaaccctgtctcaaaaaataggaagaagaagaaatgaaattcaaaatgtaaaatttccagtgcttgaatcacagttttcaaattcagcttcagtactgtcaattggcaaaacaacaacaacaaaaaccccaaactttattattttaatctatttggttcatattttgcaagagatggtggatctagaaaactttaaccgggattttatgaccttcccctccccaccccgccaaatctgaacaaagagctcaaactactttttttccttcttttattccatatcatatagaagaatgccacagttgcaaaagagcaagctatctctaaaatccagggccaagatcagcaatcccagtacttaagtcaaaagaatcaataaacagtaaataggattaattaaattcattctatgtttcaatttgtccaggttttaaacacattattcaatcacagccatcataaaataagaaatattatattaaacgcattaactttagattagaggatgacaagtttaaggaagttgcagacatccatttagatatctgtgaaaggacaattattttaatattctttaatgtacaagattttattaatatttctacagcactgtcaagaaaaaaaggaggccccaatgaactgacaagtaggctaacatatagatttgtcttgccatatttctctatgtaagtaaattcagttctgaaaaataatgcataaatatactttaatgatacaacttcatttatcctcaccttgttgactttttcatcttatgttcccaaatctactcctctgctgggttattagcattttgcagttatagttatatattttatcaatgtattagagacagctaattgccttccaatatctgttctccacttcttccctaacaaaacgctgtttatttcatcactttgccaaacagtataaaagctcaattttccaggctgtcgcctcagcttcccaagtagctggaatgtcagctaaaggagtcagtgtgacttagtcctggacaataaaatgcaagtaggggcttctgggtagacatatttttctttattcttctaagtaaaaccaaaagccatgtacattatgtttattatataaaatgtgtttgctttattgagatagaattaatgtatcctagaattctagaacacccattattctaactttattagaaatgctaagcatcagtattactgttggaattacgagaatttgaaagatagctgcatataaggtcaagaatcagtaagtagaactacaaagcagaaaaaaaattattacatttaatataacagtaaattctaagggacttagaaataaatttagcaagcgaagaacacatctgcatgaagaaaaaaataataatcatatctaagggcaaagaataagatctgaactagtgagcaaaatatctgtacattatatttcaactaaaaccaaaaggattctgaaaggtggagagacgacaaactggctagggacctcaggacccaggagaaaacatggtaatgatatcctgaattttcttatttttgctttctatatcccactctggatactggtgaagccagcaacccaggaacaccaagtgcaaagaaactgcctcccctctctgcccgcccctggaaaaagactgctttctctagccaaaggaacatgaaaggggcagcaagacagaaaacttaaaggcaataaataactccagacaaacaccacagaaaaaagtgaaactccacccgacccccaccagcaaaaaccaagtggaaagcctagacttccatccctgtctggctgtaagaggaggcaccccaagctctttccctaaatggggaacaaggggaaagttgggacattcatcccccttgagcatgatctaatatcccccttcccatctgcgctagtggagaccactttaggagcctggacttgcagcccacgcatcagtcacaaggtgctcctcccccgactgcaggagtggtgccagaggagacttgttgagtgctggactttcaccaccacttagcagtaccaaggcctcccctccacatggtgtcagtggaggtccatcagagagcagtaataaggcactcctctacctcctaatgagaggggtaccagtggaggcctagtggagagcctgaacctcctcctctacccagcagtaacaagcaaaccccctcccctaggtggtcaactgagaacagggagagaaccaagcccctctggtggtaatgaggcaaccctgtctacccccagcagtagtgttggagggtgcctgctaaaacacagatttaagtaagacccagagtcttataacataatacacacaaaaaataataataatacacaaatgtccaagtttcagtcaaaaatcacttatttaatcacaaagagatataccatttgtttgatgggggcggggagagagggataacttataccaagaaccaataaagatctcaaactgaatgattaaagacaatcaaaagatgtcaacactgagatgaaacagcttgactgtgcaacaattttcttttcctctcaaaatcttctggcccttcagattaacactccactgacattgcacttatacagtaaaagcctttactaatttataaattataaactttgtgataaaggaaagagttaagtatttccaaggaattttagcccaaggaaaagtcggcatttaaaaatttatttctggccgggcgtggtggctcacacctataatcccagcactttgggaggcccaggtgagtggatcacttgaggctaggagttcaagaccagcctggccaacatggcaaaaccttatttctactaaaaatacaaaaagttagttgggcataatggcattagcctgtcttcccagctactcaggaggctgaggcagaagaatggcttgaactgggaggtggaggttacagtgagctgagattgtgccactgcactccagcctgggagacagagcgagactctgtctcaaaataaataaataaatataattttaaagtgtatttctcccttaattttttttttttttgagggatgagtctcactatgtcccccaggctggtctcaaactcccaggttcagtgatcctcccacctcagcctcctgaatagctgggactataaatgcacccggcttcccttacttttttatttcttaaacttaccgttgattagaagcaaccggaatgaattccttgcacttctcaaatttattattctctaatattagttaccgtgcaattcttacaagaccaaaagcattttaaaagtcaatctttaagtattaaaaaatatactggaaagactcaccaaaataatttatgaatgagatgatactaggtcatttttaagaacactagaaaatgttatttttacattctcagtgtacagaattttttccaagttatacgtaaaaactaggaaaaaacaaaatccacagacctaatgcagaaatgtgatacagcttgggtgaggataaaaagaggaagaaacagctgtgctactcatgaaggactataccatagatcattgatgctctatcattagtatcatcaggatcacctggacggcaggtgaaacagattactgggtcctttccgcagaatttcagattaaataaatctagggcaggtgagaattggcatatcaaacaagtccccaggggacgttgattctgctggtccaatgaccacattttgagaaccactgccttaaagagatgatgcctgtgcagatcacaaaatataataataaaggtcagctactggaagcctaactctagtgaagcaagcagaacagctgtacctaattctgaattaagagtaagaattagaggccagggacagtggctcacatctataatcccaacactttgggaggccaaggtgggaggatcacttgaggccaggagttccagagcagcctgggcaacagagaaacactcccatccctacaaaaaataaaataaatcattttttaaaaaaagagtaaaaattagtaggagagaaagggaagtcagaccctaagttgctgtaaaggtaaaagttcataaaaaccagaaaataaaaacaagtaagcaactctcttcccatacacgacaaccttattaatgcatttattcaacatttattgaacaagaactatataccaggtacaacacatggagaacacaaacataaataagcattaactgctaaagagctcatcatctataaggtgaaacagaacaaaaagtaattgtagacctagaaaagttaaggaatttaactaaaatgacaaacacagaaaaatctgttcggcaaatttctaagttataacttcaatggcattcttattctttggtgacaggaaagaaaaagggagcaacttcactctattaacaataaaaatctctaaaaatagaataacaagtccatactgacataagctattgaataataaataaacgggagagaagagacaatctcctgtgcagaagaattccaagtaattagcaggtggaacataactccccactccctgagtgtaagttatagatcgtgacttctttccagagagcagcatgaaaagaggggtaatggaaacctgactgtggagaaacctcaccaacactacctcaccctagtgatcaaggtcaacatcaacagtgataagtcacattgacagtatgtgatgaaaatggcactgcgcttctgcgatcttcctcaaaactcgtaaccccagtctaataaagagaaaaacatcagacaagttcaaattgaggaacacttttacaaagcacttaaccaacacttctgaacactgtgaaggtcataaaaaacaaggaacgtctgaaaaactgtcacagccaaaaggagcctaaggagacatgatgactacatgtaacgtggcatcctggaacagaaaaggctcattaggtaaaaaccaagacaatttgaacaaagtatggactctaattaatgataatgtaaaaatgtatcagtattagttcattaattgtaacatgttaatatgtaacagttaataaactggttgtaggatatatgggaaccctctgcaccatcttcgcaatttttctgtaaatctagaatggttttaagaaataaaacttattttaaaacttgagaattaacttctcagaacactaatttagtttttaaaagtcaaaaaattccaatgatggaaaataaaggaatacatgaatatattatggaataaataagtatatggagatttgctcctgacaggaatttctaaataagtttaatgtatattttataatgagaggatgggaatatcaaattatatatttttaagttaatggtactgagttcatttcaccagaattacaccattataaagctacgattgacaaaatccacaagaatgcattaagcagaaaacacggccaaaaacttttcagtagtaaaactaatttaaaatgtaacaagcacaaagcaattccaattaaataaataatgaaataggatgtcagtttagaaaagaatgaatctgaattaatatttcacaatgcacatggtaatatatttcaggaggttaaaaaagtaaacctaagaaaagtcaaaaaataactaaacaggagaacatttttttactttaccttagaagaaaaatttgagtcctgaagaaaaagacaatttcaatattgaaaacttttatttttacatgaaaaataaaaactttttatgcaatcaataaaacaaaaattataggaataaatgtaacagactaggagaaatcattacaaagcttgctacccaaaatatccatatacaaaaatataggcatatgtagaaaaatacatatgtctatacacacgtatatagagatgagtataaaagttcagttgtgcattgccaagggaataatttccaagtaggaatacaataaatgaatcaagacatagcaaaatgcatagctctggtagcaaaattatttggtaaactatgcaaaaacaggcacaaagctaaaaatatttactatttggctttttacagaaaaggtttgccaacccctgggctaaagaagcaagttaattcactgacccacacaatttttagtgaggttgagatagtcattacagacaatccttttcaaaaaaggagggaaatgcaaagtacatagaatcaggttactaaaatacagagggaaatgttggaaatctggaaattcgttaagactcagtcctatttccatcgggaaatgattctccatggctctgggatccatcttccaggttcagccctctgagacactctttctttttaatgaaaggtagcacttgctttctgctaagcagttttctcatcatgcttcctacttgtagaagtttgggggtccaaaggcatcttttcattttgtactctctgacccctttaatccaaactagtagtgatccttaaaatacattcctcttaaagctttgtgggggtcctaggaatctcactggggttctttgcattaaacaaaagccacacgcacaaatctttttcagataagccctcctctaccttgagattctgctgaaatggctgcaggataaggaccatccccttaagtttcttggacgcgctattgtttgattgaatggattggtcagtcacaccattagtctttctttagaggcccttttatgtgactgaaaagtactctgaggcagaaacttagatctttcttaaattttaacaaaggattttacagccacactctcaactttgtccttagttttcctgacaatgccttggatctatctgatccttgttcaagaaggaaaccagaatatttcaccctaaaatatgcttctttaaaatatttttttttttgagacggagtctcgctgtgttgtccaggctggagtgcagtggcatgatctcagctcactgcaagctccgcctcccgggttcaagccattctcctgcctcagcatcctgagtagctgggactacaggcgcctgccaccacacccggctaatttttatatttttagtagagacggggtttcaccgtgttagccaggatggtctcgttcccctgacctcgtgatctgcctgcctcggcctcccaaagtggtgggattacaggagtgagccaccgcgcccagccaatttattgctctttattgaagattttctatgagctgggattctaaaccactctaagccactcttgagttacttttctctcatgtgaactgcactgcagcattactatacgtgtttgtttctctcttgttcatctgttttttgctgcaggagtctgtcccaactacgaacttatgaaggttgaggaaaattattatttctccctttcacttagaagaagccatttcttaatttagcatcatttactgtttggagaggctgacatggtcaaaactatcaagtctcagcaccttcaggtttatcaatcctttctttagcatacttgctcctgtcactctttaggcacaaaccaggtggcaccttcaagtctagttggaaatcttcttagctacggtactcagttcattatgtgcattctagtttctacattactacaggtgacagtgttgcattataaagcttatgctactatattagaaggatcccctttcctccagtttctaaaaagattctcccattttcctttaagcccttcctggcaacctcaccaaaaaaacatgagtctacagtttctccaagatactttagatttacactgacagtgtcttcaatgtccattcacctttcatccactacgaagttccaaagccatgcccacttaaaatatttgttgctgggcaccatggctcatatgggattgttcccaaagcaatcccagcactttgggaggccaagcaggaggatcacttaagcctaggagtttgagaccaccctgggcaacacagtaagaccatatctctacaagaaataaaagaattagctgggcgtggtggtgcacacttgtaatcccagctacttgggagactgatatgggaagactgctttagcccaggaggtcaagtctgcagtgagctgtgatagcatcactgcactccagcctgggcaacagagcaagaccctagctcaaaaaaaaattgttgacatcacttatcttacttcatttgaactgctatatcagaataacatagatgggtggcttataaacaatataaatttatttctcacagttcaggaggttgggaagcccaagatgaaggtgtcagcagattcagggtccagtgagggcccacttcctggttcacagatggccatcttttcgctgtatcctcacatagtggaaggcgaaacaagctctctcaggactcttacaaggacactaatcttattcatgacagctacaccctaatgacttgatcacctcctaaaggccccatgtccaaataccatctcattagggattaagtttcaacataggaattttgtggggacacaatcagtctactgcatcaatcaacctctagtgccagtatcaaattagttgtctactgtgtaacaattatccaaaacttgtaagcttaaaacacatagcttaagatctattatttcacatagtttctgagagtcaggaatccaggagtagttagctcaatggttctgactcaaatgtcagcctcaggcaggaatgcaatcatcatgaagtttgactggagctggaaggactactggctactggctagaggctttggttctttgctgtttgggcctctccatagggatgctcacttgactagcttctcccagagcaagtgatcagcaaaagcgtgataaagatggaaactgcaatgtctttaataatctaatcttaaaattaacattctgctgttttttattggtcacacagaccagtcttggcacagtatggaagaagaatgaatccacagggcgcaaataccagcaggtggtgggggccatcttggaggctggctgctgcagtggcttggcaattccaggcagagtctcatttacaacacccaaataaggaaggaaagaaacagggagggaaagggggaacttcttcacataacttctcttttcttagggggaaaatattgttcagggagctctccaataaacttctatatctctttggcctgaagagaataaaacagttacccactaagtgccaaggagcctagaaaaataagtatgtggcattttttgcctcaatcataaaaagaaagcaggaaagtaggaggttggtatgacttttgcatagacaacggtctaccacaaaagttaagtaaaaagcatagcaaagataaacaagtcaatgattacaatcacatattttgaatatatatttctaaattccagaaattaaatggtttacttcaaagatgtctgaaaatttgtttttaagttgatataaatgtaaacaaaaaatgctaaattaatattcctcactataattatatagcattttataatatccagactgttcatatgtattctttacaatagccttgaaagaaaactaaagcaaatattattatgttagccccactttacagataagaaacatgaatcaatggtatgaccatagctcactgcagccttcaactcccagactagagtgatgctcctgcttcaaccttcctagtagctggccctacaggcatgccaccatactggctaatttttaaaatttttttagagatgaggtcttattatgttgcccaagctgctcttgaattcctgacctcaagcggtcctcctgcctcagcctctcaaatagctgaaattacaggcatgagtcactgcacccagcaaaaaattatcatttttgacaacactaatactacagtaatttgcttaaccctctatcactgacattaggttatttcccatttgtcactctcatagtcaatcctatcaaaatattttcatgcattatttttccctccttacttagtttattttattaggaaaaaataccacaaattggctgactgggtcaaaacatacatacattttttagaaccttgctatatgctgatttctaaaagcaatttaatatagtttagttaactaaagatgctaccagcatgagtataccatgaggttcaccaaaacctcaccatccccaagtacctcgttgaattcttgcttatttagaatgaaataaaatgttctcttatagttttaatttgcatttatttgattacttgtgggattgaacactcctttttgtgtttttcactttgttcttatgagaactataaattcatatctgtatttcatttactatagtcttgagatttttcttataaaatttaataagttatttctcataaacatgctttgttatttggttcaaatatttcttctaatgttaccttttttattttggtttaaccaacattcatttgtacaaaaaaagttatataataattctattctataaaatgctcttcagtgttttgttttgttttttcactccaaaatggaaaagttactagctgtccaaaaagttgataaacatgctaccagctataatacttattctccttttaatcagcctggggtttattttgatctatgatattcaatttaaatttagttgcacaattcaaaaattgcacttaactaaagatgcccttttgcatgctgctaactgctatagatagttgggcggattaagataacccaaataatgtggaactactataaataatataaatgctgtgaatttaactataaaatttgccataggaaatcagtaaggcatacgtaaacattacctaaaagagacaaaacagctcccagacccacacaaggtggctataacctaattgaaagtgctctaacattatctattttagaagacaaatgggtcattcagaaggggcactggtcagccactggcgtatagggcagggaaaaaagttactgggtttttctcctttttcaattaattcttcctactaactatacatttcttttttcaccaatcattttcaagagttttttagcttcctgtgcttgttatgtggtactcccactctcctttatttaggaagttaatgattttagttatttcttattttatcctagagactaaactttttctcaagtacactctaggtgagttgtctggtctcagggtctggatgtttctgatctggaggtgagactggtatcgacatggctgcctaaggctatctttgctgatgttatcaaatctttgaagcctaattcgtaattcctgttaataccgcaagtgtcatacctgttctcttcctattttcatagaattgcactgaaaggcttaatagtcatataatccaaatagaaactcaatctgcaagcctttcacatgaattattatcaagacatgttcctctattcactgtttctattttctggctttgtttctttaaaaagtgttctgttaagaaataattaacaataagctgcacatatttaaagcgtacaactcaaaaagtttggacatatgtgtatttacctgtgaaaccatcatcacatcaagatagtgaacctcctaaatctttcctgtccctttgaattcctttcctccctttccttgttgtctcctctgcatttgatatgcttccattgcaatacagcacttatatttttcagaacttttaataagtgtaatatattcttttttgtctggcttctttcacatagcgtaattgttctggggttcatccactttgttacaaatattgctgaggagtattccattgtatagatataccacaattttgttattcaattacctgttaataactactttggaaaacggttttagcagcttcttaaaaaataaaaaaaggctgggcgtggtggctcacgtctgtaatcccagcactttgggaggtcaaggcgggtggatcacttgaggtcaggagttccagaccagcctggccaccatggtgaaaccccattgctactaaaaattaaaaaattacctgggcttggtggcacactcctgtaatcccagctacttatgaggctgtggcaggagaattgcttgaacctgggaggtggaggctgcagtgagccaagattgcaccactgcactccagcctggacaacagagtgagactctgtcttaaaaaaaaataaaaaacaaaaaataaaataaaaaacaaaaagtaaaaaaaatctacctaccattccattcccaggaattcactcaaaagaaaagaatgcatatgtccatataaaaacttatacatgaatattcatagtatctttatctgtattagctaaaaattagaaacaattcatctccatctacacagcacagataaacaaattgtggtatattcataaagtgacatactacttggcaataaaaaggaataaactattaatatacattacagacaatacagataaatctcagaataactaagctgagtaaaagcagaacaaaaaaacgagtatttatttcttgccaattctttttttaatgtacctggtcactttatagccccttactctttatttattttataatccctattttatttattgaacatattaaactatgtacatatatacatatttagacatacatacaagctcttgatctgttgcccaggctggagtgcagtggtgtgaccatggctcactgcagccttgacccccaggctccagcaatcctcccacctcagcctcctgaggtacgcaccaccatacccagctaattctatttattgtagagacagggtttcactatattgcccaggctggtcttgaactcccgggctcaagcgatcctcttgcctcagtctcccaaagtgctgagattataagtgtgagctactgcaactggccataaacatatttatttcatgtaatgtatatttctaataatcgaaatctctatagatctctttcagttgtttgctgtttctgctgactcttgctcttggtgttttgatgttttctcccttgttacattttgtaattttaaaaaatgtgtatgagcttatttgttagaattttaactacaattatttgatgaatgcattgatcgtacattcctccatggaggatttttttattgttcttacaaggtacctgagagtattacagactgaggtccaatttaaattaaaatcctccacttgtggagttttagaaactgtaaaaattgtgtaaattaaggccccaaattcaagtgaatgtgagctgataaccaagaattattagggaagattttaagtctacccagaactgaatatctttgcaagatggtctctgaccaggcttcttacctttatatgggacccagggatctttttctctagtcctcatcctgctccttacacaaagcttcaatgccaacagaaatccatggatgcccccaaagtattcaatgacttcagcacctgcttatctcacaggatatattatacttgttttgtttctagccccagaaagtttcccttattttcttaatgggctcatccattcatgttaaaggatattttttatactgaatctagtactttacatgtttggtggagggaggaattcaggctctctagtctatcatattgctacaaatcagtctactatttctgcaactgctttataacatttaaatacaatattatatttattcctgatacattttattttggtatgttgagcatagtctacacgtctgtcgagagcacttaaaatcttgattgagtcatcatactagcttaccttagaagttgtatatcatttgcaaatttgtttgaaccttcttagctttcaccaaagtcactgatcaccacagcttctgacaaaaagaaaagctttaaaattaatttttaaagtctttatagtaaatccaacatattttcttattgctttcaggtatacagaattacaaattaaatttccatcataatcaaatactaatacatcaaattaaaacaggtaaattttcatatcccaataactcaagtggcagacctttcaaacagtagtattgaactgaatgaaaaatatatttatcatcaagggaaaccagtggaaacataaagcgttagtttgggtaaagggcgctctagtacctctgaaatctccaacagcccccatcttcaaaaggaagaaacacaatttatttaaactagtatcttaaaggtcagtgtttacaaaaaggctgtgggaaggctttcctgactgaaggatgctttcttccccttagatgttcagtaaaattttagctctttcatatttctattgtttcctagcacaaaacatagaagagcactgaagggtcataaagggaagctttgaagggtttcttgcttttaacaacatcatgaaaacccatgcctgctagattttttcttttctactccaccacttttagttcgcacctttactaatttcagtcaccagcgacaatttctgtaaaatctatctccatcacaagagtgtgtatgcgtgtgcttgtttccccatcagaaataagagaaaacttacgcttctctcctttagtgcattgctcttgcatgaagaatgaacaaaccactgatttggggttcgcatctttacgttctgaacagcaacttagaacactttgctcctgatattctttcttctcaatatttgatggatatcctgcaataatgtaggaaaaacagcacaggctttggagtcacatcaatctggttttaaatctcaatcttctacttagtaactggctaatctgaagcaaatttttaatctctctgaacctagtgggaaaataagatgggtctcaatgtacagctgcaagaaacaaatgatatagcatatatatatagtgtcagcaaagtgtctaccatataacacaaactctattatgttagctttcctgtgtaattttatgcttcattttcactttactcagtcaaacgaatttccagactaaattttcttacgttatagccttgataaattttatggttttgtccaacaactatcaacattttaggccaggtgtactggctcatcactgtaataccagcactttgggaggccgaggcaggaggattaggcctgggagtttgggaccagcctgagcaatatggtgacaccttgtctctacaaaaataaaattaaaaaaaataaaaaataaaaacattttgcaacacttaatgccttcaaaatagcagcacatcaatactactactactactgaatatatcccaccaagaaagtacatttcaaaatctatgttctagagccactagaatttgttcctttttgtgtgtggttatgtcaccaaaatgcgatatagatgtgtaaacttgtttcatttccttttcagatttttctttcattctacttttttatttaatcccacttttgaatatgtagacatacatgatgatttagggttaaaactatagaaacaacttccatttagagaaatctctcttctgttgttggcacctttaccctgctccttccttctgcggatacattgcatacttttccatgcctttgttttttccacttcctattgtattctacagatcattctctattggtatatagagactttctcccttcttttttatgacctctatggaaagacggtgacttggaaggggcacaatctacctgcagactgttgtactgtctggatgcaccttagtttatgcaatcagttctctattaatgggcattttagttatttccaatcttttgcaaatgcaagtaatatgctgctatgactaacctccctttgactattccctcccatgcagtttatgcttatgtatccttaccagcaatgtatcaaagtgcctatttccccacagtctacagggcctattgtataacttttggattttgttgaaaaatgctttaacatagctttaatttatatttttctttgtatgactgaaggtggaacatcttttatttttgagatgaagtcttgctgtgttgcccaggctggagtgcagcggcatgatctgggctcactgcagcctccgcctcccaggttcaagcaattctcctccctcagcctccccagtagctgggattataggtgctcaccattacacccagctaatttttgtatatttagtagaggtggggtttcaccatgttggccaggatggtctcaaactcctgacctcaagcgatctgcccaccttggcctcccaaagtgctagggttataggtgtgagccaccacgcccagtctggaacatcttttatatgtctgtcatgtgcatttctttttcatatctttggcccattttcctactgggttgatggtcttacttgcctggaattttacgaaggtgttttcatccaggaggttagctctttgtgatataagtccaaatatttttccccgctttgtcgcttgccttttgactttgctcgtggcatttttcactatttaaatacttttttattaatatagtaggatttatcatggtttttctttaagaatgagtcatagttataaaatctttggcttatactttcgtagactttaaacatgttgttccatggctgttttgctttgtatgttgctgtttagaagtctgttgctaacctctcctttctgtctggaagcccagaggaatttttcttcatcattttgaaagtccaactgttttactaggacatgacttggaactgaccattctggatcaattttcccagtacacaatgagccttttcaacatgtagattggagtcatctcttatttccagaatgttttcatggattgaaacttaactattagctttgctattgtttttttcttcttaggaactctacttttacttattttctatatcaatcactttctattactttttaacctttcttcatttaattttcattatcttggttgttttcataccttttctcaatgctccttatattcagtccaatcttttcttatgtaccttggaatttagcttcatttctttctttatgactttttttttttttttttttttttttttgagacaggagtctctctatattgcccaggctggcctcaaactcctgggctcaagcctctcaaatagctggaactacaggcatgcaccactgcatctggctttaacttcattttaaaagctgatttttcttttgatttattttatttcctgagttcagtaaattcacttttcatatcttcctctttttgtccatttgttttgcagttttgaatttggatttgagactttttatctctacaaatgttagtttaaggatattttaaattctggtaggagtactgtgctgtagttttctttagtgctatagttggatgtttcgggaagacttttcatcagctaaaattttttaaaaacttttttccttattttttgtagagactaggtctcactatagtgcccaggctgggctcgaactcctgggctcaagtgatccgcccaccttggcctctcaaagggctgggattacagctgtgagccactgtgcccagcccagttgaaatgttttgactatcattttgttttccagctaaagtaactttatatggatgttgcctgccatcttctgttcatcttgaaatattttatttttcctaaaccagatatagttgtgtataggcagaagcaaggaatttagatgacttaactggatttcttagtaaatagtacctaataaagtgtttttttgtttgtttgtttttaattaatgactcctttttgggtgggagaaatgagtatctattttctattctggttcaccaagatccttaatttctactaccccttctctctatcaccaagcctccaggtagatggtgacccttccaaggcaccctctttcctttccccagaagcagtactttcatgagactgcgtctttggtctcattttctttcaagtctcttattttgtctaatggatcttacacctcttctcacttctctatccagggtggggctttctctttctgggaattatctgtattctgctacccctaggtcctgcaacctctcctctttttttacagtctccaccttgcttgccacttctccatggattctgctagactgcagtgttgatttccctgcatgcccatagacattttgctagctattaatgtatgcttacatatcaataaatttgtatgggttttctcttgttaacctactgttagtttagttcagccaactcagttatcaaaccttcagaagcgaaatttaagcttccctgcaaattgctggttattatttaatattattttgacacagggtctcactctgttgcccaggctggagtgcagtggcgcaatcacagctcactgtagccttgacctcctgcgttcaagagatcctccgacctctctcagcttcctaagtacctgggactacaggtgtgtgccactacgcccagttaatttttttattttttattttttttaagagacaagctttcgccatgttgcccaggatggctggtctcaaacttctgggctcaagcaatcttcctgcctcagccccgcaaagtgctgggattacaggcattagccaccgtgtccagctggtattatttttattagtgttctatcttgcacttctgagtatgtttaagcttccacctgtcagcttcaagggcttttttctcccagctaatgcctaaaaggcaaacaaccttattctacttctcattcaccctcctcttttcctcccatttttttgcgggttatattatttctacaatgtcagaccatgtaatatttatatactattctatcatcattatcctcatcttttaatcttgatgctacacacaaaatatatttgatttgctcaccacctgaccttatgttgaagattttccaatcatttcttggttgtctgaaatttgttctctagtatacgcttcagaaggattcatgggaacaattatagccattttccttgaattatttcatgtttataaatgtttgtcaatgccctgaattcttgaagggtagtttggtgagataggaattattttatttctttgaataaatactttcttaatatctgacataaaatgttgccaccaaaaatccaatctgattttctttgcaagtgacctgctctttttatttcccccatcaatgcaagaagggtttatttttaaaaatccaacaattttacaggaccacatctcagtgttaactgttgtgggttgatttctccaggtttacagtatgcctttcaacatatgttacatttaaacctactttaatgttaagcgttcttgaattacagtcctaatagttgttctggtccattgctttggcttgctttgttttactgtagtaaaataaggaacataaaatttactgttttaaagtattcaataagtggcattaagtatattcagtgttacataaacatcaccactatccttgggcttacatttggggaactccatttatatttattctggctctctttgcctgtcttgtcacctcttgactcctttttaaaaatctttttattttcttcatttttccatttttcttatcgtactttctgtgatgtatattcactcttggtttctaatgcaatcatcactttaaactgtctttttcttaatcttttattgagttttgtctgctctcattgcacctccttctatggtctagccatctcatttctttttttcccctgaaaacatagaaagaggtgaattttatttacttttttataatttcaagttctcttttagatttgggggtacatgtgcagatttgttacatgggtatactgtgtaacgctgaagtctggagtatgacagatcctgtcatccaggtactgggcattatactcaacagttagtttttcaacacttattgcattccttccctgcatagtattccacggttcatatgtaaccaatctatccctgatggacacataggttgattccacatctttgctattgtgactagcactatgatgaacatatgagtgcatgtatctttttggtagaacaatttcttttggatatacacccaataatgggattgctggtcaaatggtagttctgagttttttgagaaaccttcaaactgatttccacagtggctgaactaatttacactcccaccaaccgtgtgtaagtgttccctttactctgcagccttgcccacatctgttgttttttgactttttagtaagagccattctgactggcgtgagatgatgtctcattatggttttgatttgcatttctctgatgattagtgatgtggaacattttttcatctgtttattggccacttgttcttttgagaagtgtctgttgatgtcttttgaccactttttaatgggttttttttttttttttttttgcttgttgaattaacttccttatagattctggatattagacctttgtcagatgcatagtttgcaaatattttctcctattctgcaggttatctgtttgctctgttaatagtttctcttactgtgcagaagctctttagtttaattaggtcctacttgtcaacttttgtttttgttgcaattgcttttgaagacttagtcataaattctttcccaaggctgatgtccagaatgtttcctagattttttcctaggattcttactgtttgagttcttacatttaaatctttaatccatcttgaattgatttttgtatgtggtgtaaggtagaagtccagttttgtatgtggtgtaaggtagaagcccagtcttatacacatggctagccagttatcccagcaccatttattgaataggaagttctttctccattgcttccttttgtcaattttgttgaccagatggctgtgggtgtacagcttaatttctgggctctctattctgctccattggcctatatgtctgtttttgtaccagtaccatgcttttttggttactgtagcctcaaagtataatttgaaacaagctacacattcagtagcactgaatgtgtagcttgttttgggcagtatggcgattctaatgatattgattcttccaatccatgagcatggagtgtttttccatttgtttgtgtcatcaatgatttctttcagcagtgtcttgtagttcttgtagagatctttcacttccttggttagaggtattcctaggcagtgtgtgtgtgtgtgtgtgtgtgtgtgtgtgtgtgtgtgtgtgtatggctatcgtaaacaggactgcattcttgatttggctctctgctccaacattattggtatagaaacgctactgatttttgtacagagtttgtatcctgaaacttactgaagttatcagttccaagagcctttggtggagtctttagggttttctaggtatacaatcagatcatcagccaagagagatagtctgacttcttttcctatgtggatgccttttgtttctcttgcctgattgctctggctagaacttcctacgtatctcatgtctgagctcttatttctgaatttatgtggttctttcaaagatttcatcttttccttaaattctcttagcttactctgaaatatttagattgtcattttcatctgctttgtggccacatttttggggtatgttttcataatctcgtgcaatgttttatggcttattttgatgattttcttataatgatttagtgtatatatatatatatatatatattcccttttcccatatatttatataactatatactaaaaggaggttcccggctaggtacagtggcttatgcctataatgctagcacttcgggaagccaaagcaggaggatcactggagtccaggagtttgagaccagcctgggcaacatagcaagatgccatctctccaaaaaattagccaggcatggtggcacatatctatagtcccagctactcttgaggctgaggagggaggttcacttgagcctggggggtcaaggctgcagtaagctgtgatcatgccactgtattccagcctgggcaacatagcgagatcccatctctaaagaaaataaaaaggaggttcctatgttacactgtatggacatgctggagtttaaaaaaatctatttcctagtggaatctggttgtttccagttttggccattacaaataaaatcgctataaatatttgcagagcagccaatataggttttcatttcacttttcatcagagaagcatacaatcatcaaaggggaaattaaaaccacaatgagataccccatcatacctcatataaaggctaaatattttaactgataatgccaagtgctgacaaggatgaaaaactactggaactctcttatcttggtggtaaatttcaatctagagtgggcttgccagatcatgtgataaggatatgattaattttataataaactgtcaaattgtcttctaggtggctgtactatttgcagtctcaccagcaagactaaggtttctccttgttttgcatccttgccaggaaatgtattgtttgttttgacattctgagtaagaggttgtgtagtatctcactgtggttttaatttgcatttttccaatgacggtggttttaatttgcattttcccaatgactattctatacttctttcatttaacacaaaatggtaaccactttcctatgtcattcaacagcctatgccactactctttgaaaacgttccttttaaaaggctgaaaaatataatgatgggatgtgtcataatttataaaaccattcttctaccattagatatttgttatttccaatttttcacaagaacaaaattacactgtgattataaagctttgattctatctctatttccttacaagtttcttagaaaaggtcaaaaggtatatgaacttttgtttctccatgcattttgacaagccaactggaagatacaagtcaagtggaagatacaagcatggaatcaagtaattaagaaaaatgattctcaggccaggtgccgtggctcacacctgtaatcccagcactttgggaggtggaggcgggcagatcatctaaagtcaggagttcaagaccagcctggccaacatggtgaaaccccatctctactaaaaatacaaaaattagctgggcgtgatggccggtgtctgtagtcccagctactcaggaggctgaggcaggagaatcgcttgaaccacggaggcagagttgcagtgagccgagattgcaccattgcactccagcataggcgacaagagactccatctcaaaaaaaaaaaaaaaaaaaaaaaaaaaaaaaacatcaattattttgctgtttgttttgttttttggtattcctgatgcgagatgtctttatcatgtattgttgattaggttgttcatcagttaatcttgaataactgaaatctaagctgaaggcaataatacatcggctttcttttcatgcaagtcaaactgctaaaatctaccacaaaatattagcctttcatcagcttggtcttcagatccaatacattttcccctcaaatgaaagacaatgcaatgccatccacaacaatgctaaaaaaaaaaaaaaaaaaggaggagggaaacaaggttaagtcctgtcttcttcctcctaccccaaaaagagctcagaaattaaggtgctttccctaacaaagcctcctcctgctccatgaagtgaccaagcatgtcatggcagacccagagatttataatcttcaacatatcgttatcggggaaatcaagatttgacaaaattcttccttcacgccccgtttctgcaagaccaccactttctagcttaaaataaagaaaaaaaaaagacagctgcaggaatgcttggctgcccgctaatgtacaattttgcccaaacgcagaacttgacgcccactattaccaaaggatggccttagtaaagtaacccccgcgaagagcaaactgtttagcagccgctccctcgaaaaggacggaagaggaggtctcttctgaacctgaggatagtagagaggcactccccttccactactagctttgctcctttctcaatcaggcagttcatcagctagcctcctttgtcaaagggggttgatggtcagaatctttgcgagacaaaaattactaaaagagctcccaggaaccaatgttaaggcatcaaaggccccgcccagcccccacaatgatcaacaaaccaaaacctgggatccctactattaccaccaccacaaccatcaccaccaccaccaccaccattcctcgctctctctagccagggatgagactcaggcccaggaaacccatcctttccgcaagtaggaaggcgctgggtctcctcccttaggcctctcctttaccccattgttctctccggacccctccactacggccaggcgctatgtatgttttcaacccccaagaagcccagtcccagccacacacaagatggcagcctcacacctaccggaggaaacagctgcgccaccactccagtgatgccggcctctcgactacgagtaactccattggctcagctacagtgcgcgagacaagccgagagcgctagcagtcaatcgggaggcggcgcgctcgggcgccactgcggtgccagcggtaagtgcgccgagtctctgaggcgtgaaccagtggggagtgcgaccaatcaatgggctcctggctgggtggtgggacggccggcgtccgactcctcccatgtagtgatcggtttaggtaggtcggcctggtccccggcggaggttacgccttccctcatccccggtagaggcagggcgggactgttgtggttgagatgaaggctagtaaatggtgaagtacttcccggccagagggcacctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacaggtaagattacacgagcccttaaatacagcaagttcagtcattcatccaagatcatggagttcagattagatagtaacacttctgactcgctatcagccacagcccaataagtaattaagtaaggaaagatatgtaattaactgtgctctttggcatgtggaaacctgcagtgagctctgtaaatactaacacatgaggccaaggagaggagtaaatttgaagaggtcaaatggagtaaccaaagcataggctctgaaaccatgctgcctggttccttatttcgtgtctgccacttacggtatggcattccttagcttcctcatcagcaaacgagctgctaatttaacccacatgactgttagggggattaaataagaacacgtgaagtagttagaagcgtgactaacccgtggttcttaagcgtgacttaacccgtggttctgtcgttacaattaaaacgtaaggagccgagaggaaatggtaaacgtgtttttaaagcctgttttagaaacgaaaaggaaccatacattgaagcaaagcagactggcttaattatttttctaccaaaatgaaaaagtgagaaggggaaaaaagttttttaagcccatttactctctgaaatattaacaccagttgtctctggatgatgggatggtgtttaaattttctcctttatgctttattgtattttgcagattttctccaggaaacatgttttacttgtgcacgttcagttttcaaattttcaggtgtgaacgctggtgagagctgcttaaaaacaaagctatgggccgggcgcggtggctcacacctgtaatccccacactttgggaggctgaggcgggcggatcacctgaggtcaggagttcaagaccagcctggccaacgtggtgaaaccccgtctccactaaaaacacaaaaattagccgggcgtgtggtggcgggcccctgtaatcccagcttctcgggaggctgaggcaggagaatcgcttgaacccgggaggcagaggctgcagtgagccgagatcacgccactgcacccttctcactgcactggtgacagagcgagactccgtctcaaaaaaaaaaaaaaaatctatggccgtgcgcggtgggtggctcacatctataatcccagcactttggcagatcacttgagcccagagttcaagaccaacctgggcaacatagacctcatgtctaaaaaaaaataaaactattactgagtgtgcttaggtggaagtataaattggtagaacctttctggaagagagtttgacaatatgctataaaaagctttaaaatgaattcctttttgaacatttatatatacttaatttttaaaaattaagtacacttttacattcttttacagaattggtaccttgtagataaagagcacaatccagattttgaccttgagttttttcttgcgtgtcaaggttatacttataaaaacagttgaatagcttcccgtatttttccttcttgaaagttcgtatatgataaaaattctccgttctttgaaagttttgtacaaggaatgttccctcactcctctccctccctactcccgctggagactttggtacagagctttcaagtgttttttaatacttacaccttttaatactgttacatattctatataggtgaatatatacatttgtaattttttagtggaaaaatactatactacatcattctgtagctttatttcttgacattgtttttgcagcctgtacatgttatttatagctcattatgttatttatggatcatttcttttacctgctgcatagtgttccagtgtatgactgaattgatctgttaatataaaacatttctttgtctcttttattggtcttgttgttaaatcctattttgtttgatgtgtgctgtatagcacattttattgccattctctgagaacattaggtttccagtttttcaccatacaacaatgctgcaaggaaaatctttgtgttttcttgtgcacatgtgctatttctctaggatatatacctaaaagtggaattgcttggttttaagttgtgagcatttttagttttaataggtcatgctaaatttgcctccaaaaatacctctactaatttacatgttccacaggtagtttatgagagttaagtttctctacagtttagactaacatgagatattatcttcttcatttttgcctagtgatggctgcaaattatatttttaattttaattttcattctgtgatctaagattgaagtgtctattatgtttgttaacctataatttatatgcatttctatagttttttaaaaacatgtttaagttctttatgtgtcctcgatactgtatttttagaagtctctttggtgtgtatggttaattatgcctcctttttgttgctattgttaaaatatgttaaaaacattttctcttagcttcttgcttggcttttgactttttgttaacttatttgttctacagatggattttcctctgccaatctttaggcctctttttatcttactgaatttctctaagacttccagtacagtattgaataaaaacagtgatagcaactgtcttcatcttgtgcctaataaaaattctccgaatgtttcatcattgagtatgatgtttgctgtcattgagtaggatgttttggtagatagcctcgatcagaataagaaagttctcttttttcctaatttgctaaggggcccccccaccttccatggaataattttatattgaattgttttgtttttctgcatgaagtgatagttttcctccctttgcctgttaatataagcattcacattgataaacttttcatgttaaactttttaggtattcttgggataaactattttggtaatacattcttattctactgctggatacctttattcagtatttttgtgtctaagacccagtagtgatttgggccttgagtttttttcttgcatgtcaaggttatacttatctcataaaaaaaagttgagtagcttcccatatttttcctgcttcagaacagtttgtatatgataaaaattagccgttctctgaaagttttgtacaattcatctgtaaaagtttatggacctagtgtactagcagtgaaaaaaatttcatatctcataaaaaaaaattgagtaactgcttaagaaaaagttgagtagcttcccatatttttcctgcttcagaacaggtttgtgtttgataaaaattatctattctttgaaagttttgtacaattcatctgtaaaacttaatggacctagtgaactagcagtgaggggtggggatgtgtggcacacatctctagtaatatcttcagtgttttgagcctatttggtaatttatattttcctagaaaattgttcagttcgtctgtgctcaggttcattgacataaaactgtctgaattttaaaatgtttaaaatctcttcagtagctagagatctatcttcatttgttattatttattttgttgcttttttcccagcttctttaattgaatgtttaagtcaatattttcattttgctaataaaatttatttaaggcctaaatatctcttggcatgctgctttggcaaaatccttcaggctttgaaatgtattacttcaaccgatcaccatttctaaatgttcttaaatttctcctttgatttcttctgtaaaccatatacattatttgggaaatttgattttttaatttccgcaggtagtatggggtggggggttgatttactacattcagtgactatgctctgtgtaaacagtcttttggaatttgttgataattccttttggtctcataatagtttttgtaaatttcatgcttttcctcccacaagaagtattttctgttgggtgcagggttctatatattttttggattaagcttgttaatttgtcatttaaatcctttatactctggttttttacccactttatctcagttccttagatttgttacttcatcaccaaattgtggatctgtgcattttccttttaattttgctttatatatttcagagtgatgttatttgtacataaagggtcatgaatattaaatctggtgaattgttctgtcagcataaaatatttgtgtcttttattgattttcatattcaactcttatttgatacgtttcttcttataattgcagatgtctttttccagtctcttcgttttcagccttgctgtgacattttgtgtaatttaagtgggtctcttattttaaaatatcatatctgggttttgcttgccatccaatctgagagtctgccctttaataggtaattcacctttattgtgattattgacatattttggccttattcttgtcattatttaacaagcttctctttgtatcttttatatcttatttttccacctgttttttggaacagagtcttgctctgttgcccaggctggagtacagtggcgtgatctcggctcactgcaacctctgcctcccaggttcaagcaattttcctccctcagcctcccaagtagcccagattacaggtacacaccaccacacccagctaatttttgtatttttggtagagatgggatttcgccatgttggccaggctggtcttgaactcctgacctcaggtgatccacccacctcagcctcccaaagcgctggcatcacttttatttttaattgaggttagccccaagttttctttgttcatttttttttaagttgattaactttacatttcacagttcttaaatttatgttttcttaacaaagtgtacatttagtcagttttgataaggcccctgtaaagaagaagttagcatgcttctactttgctttctctcatcttgaaacaatcccttccatctctcctccagaaaagaacataatctctcatgatatctttaagaatttttctttcatttgttattaaattcagtttacatttaacattaatgtgttttactcatttatttgctcactattgctacgtatacctcagtgctttcttataggttcatttttcatcatcagatacttatttctttcacagtctctgagtgactctttgaatgtctgcaaatgtctttttttcatctttagtatggaaagatagcttggctggatatagagttctgggttcatactgactttgctttaacattttgcatctgacatttctgatgagaaatctcattactagtctaatacaccttccttttagataatctacatttttctggaaacatctaagactttgtgtttttgatattctgaagttagtcacggtttgtctagcgatgtgtgttaagaattttatcctggttggtactcagtggattcagtttgcttatgtgttttccagttctgagaaattcttgctcattattgcctcctctccattttctcaattttttgcctcctcttgtttccttgctctgtgttcttggtgaattactcaactcagtcttccagcttactaactggctcttcatgttagtctgttctgtcattcagtcatctattgagtttatttcaacaactgtttttatatccaagatagctaactggctttttttcaaaattgtgtgttatttcatggatgagatttccttctttagctcagtctctttcatagtgtagccttcttcagatatttgaggactctcagttgtgcattaatctcctctgagaggattcctgcccatcgttttgctgttgtgattgtggttgccatcatctctatagcttcccatctgtttcctttccccagaagggccttactgacttggcccttagagagttccctttttgttttcagcatggctatatatatatattttaaatctcctaacatttccatggtttggtgtggaagtggcagaagaatttacagtatcttgactaacatcttgagaattaaaattgttgatctatttttgacctattattctacctccagatatgttatcctagggaaattgccagagatatgtataaagtatatttattttagcattatttattatactaaaaattaatctataaaggaaaacaatctaaatatcgaatatagaggtttatattattaattaatatttttattaaaatttaattattaaaatatttaatgtactataatgtatgcgttattgaccaaagtatgttatacagccagttgtattatacaaaaatattagtgatggaggaaaatgcaggaaatgtttttaatgaaagattataaaaaattaaatatactacaatccaaatttttgttttaaaactacattctgaaagaataacaataattggtagtattccttgaatctttcgtatgtcaggcacattatatgtaattaagtcttgtcctcagaacaacctgtgagatagttagtattatcccctttttaaaaggtttataaaagacttataaaatggagatagtaatataaatacaaatatattaaatatgggtgataggattgggtgggccttctctattatttctaattttgatactttacatattttttccagataacataatgtttttttgtaatggttcatgctgttttaaaagatcaagctgttataacaatatcttatttccttatatatacatatatatatatatatatatatatatatgtggtcctttacaaatatgcactattctttattgttttccttacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggtaggttgaagaacacactgttacactttatatctaaaagtataaaagtatatagacaatgtaagctgatgtggaattgtcaaggttttgcattgcgaggaacttttctgaattagagggaattaagggtttattcttgtatagccaccaattttgactgtctttatcattagttgtgaaaaaattgacttttttgtaaacttttttttttttctttttttttggtgatggagtctctgtcgcccaggctgtagtgcagtagcacaatcttggctcactgcaacctctgcctcctgggatcaagcgattctcctgccacagcctcctgagtagctgggattacaggcatgtgccaccatgcccagctaattttttgtatttttagtagagatggggtttcaccatgttggtcaggctggtctcaaactcctgacctcatgatctgtccaccttggcctcccaaagtgctaggattacagcacttgcacctggccaaaataggtgagccactgcacctggccaaaatacttttagtgttacagaaaaattgagaggattgcagagttccagtaaacctggtacttagctttatctatgattaacattttacatttggatgctacatttgttacaattaatgaaccaatattggcacattattattaactgaagtccatagtatattcacgttagtttttacctgatgtctttttccattccaagatcccatccaggacaccacattccatttacttgtcatgtctgcttaggctcctcctagctgtgatagtttctgagacttttcttgttttttatttttttgggattttgtatccaaatattttgtaagatgcccctctgttggaattattgtctgatgtttttccataatttgactggagcgatgggttttggggagtgtgatctcagaggtaaaatgtcattttcatcacatcatatcaagggtacatgctgtcagcatgatttctcagagttgatattgaacttgatcaacagagcttgagctggctaatgtaggtggtggtatcaaatttctccactgtaaagttactctttttctcccattccctgctatactcttcggaaataaatcactataggtagcccacagttaaggagtggggatttatgctccccctccttaaatgtggaatatctacgttaattatatttggaatatttctgcaggggagatttatctctctctcttcttccctgtttatttattcagttaatcatttatatcagcatggactcatggctatttattttatactttttgagttacaagccagtactactttatttattttgtttttcaaattgtcccgggtttggctattgggagctctttcagttggctcttttttttctttttttttttaagatggcgtctcactctgttgcccaggttcatgtgcagcagcgcaatcttggctcactgcaacctctgcctcctgggttcaagcaattctcttgcctcagcctcctgagtagctaggattacaggtgtgtgccgccacgcccagctaatttttgtatttttagtagagatgggggtttcaccatattggccaggctggtctcgaactcctgacctcaagtgatccacccgccttagcctcccaaagcgctgggattacaggcatgaaccaccatgtcctgctcagttggctcttgtgtccctttgatataccgtcatcagtgtaggtattttttatttgtctttgttttatagcacttcccttttggcactcgaagattgctctagattgctctcgtatatttcttacgcatcttagagtgagccatttcttgaataacctgtcaatatttttattggaaaatggtattagaaaccaaggtctgaatgataggtgtatttgttgttactggagtgtccttgtttataggccctttcagctggcagagcaatgaagtatatatatatatactaacttatatatacacaactcatggctataaatatttctatatgtaactgtttgtatctgccttaagctaaccatgaaattacgctgatgtttccaactctaatctattaccacgtggatcattttagtctcctcaccttatctgtatgctcccactccagtagtaaaaaacttagttcccatcacccaccatccatttacttaattgttcaattccagtatatatatgtagcagtatcagaattgttaacccttgactgggcaccgtggcttatacctataatcccagcactttgaaaggccgaggccaggagttagaccagcctggtaaacatggcaaaatcctgtctctacttaaaaaaaaataataatagtaatacaaagtggcacacgcctatatgtaatcccagctattccagaggctggggcatgataattgcttgaacccaggaggcagatgttgcagtgagctgagattgtgccactgtattgcagcctgggtgacaaagcaagactatctcaaaataaataaataaataaaaatagaattttaacccatccccaggtaggaaaatactttatcaactagagtacagtaagtaagtaagtatatgcagttacttttgcctttatttttacagactccactcatttccaaagttacttaggtcagtaccttttccacccagcccttggtgaagttgtttatacatttgtaatacagttagattctcttcatagtctgcattccttactgagatccctgacgtcctaaatgatttttaaaatttgcatacgttattagttcattgtttactctttaaattctgtgggtttttacaactgcataatgtcatgcatctataattatagtatcatacacaatagtttcggtgcctttaacatagttgtaatgtatggattgttatacagatcatagtactgatttcaccaggctgtgatctaagccagtggttctcaattttttttttggtctcaggatgactttatactctttagagtatttaaaaccgcaaagagcttttgtttatgtgggtaacatctgttgatacttactgtaatagaaattgaaactaagaagtttcaaaaaatattaattggcttatttttaagaaaataataaatccaacatgttgaaaatataaatagaaactattttctaaagcaaaaatattagtgagaaggataacattgtcttaccttgttagaaatatctttaataactggcttattagattcttatatctgcttctacattcagtcttctgtgttatattactttggttgaactgaataaaagacaagcttcacacagacaggaagctgaagaaggaagagtatttcaatagcctttcatctaattgtggatatttttctttgttgactccaaaactcaacaggtagtcattccttaaaggttagttggagtgtggagtctgacatatcattgagtatttttacaatgttacattaaaatccattggtctatcttgcactttgagtagatcttttaccatgtatgattttacatgtattgaccacttgtaaaatattggctcagtgaattatgcagatcttccaaatgttgacacatttaatcatataattttaaaatcacatttgttaatatagctactgatctcattttaaaagtggttaactcttcagaaactttcaggtttgccatggcagatacaaggttttcaaaattctcattttcattctgtagcttgaattttgtcattagcaagaaatattgttagttttgtccttcaagtgataggctcactttgctcatatgccaaacactcaagtctggaaaactacagttttatcagtggttcttttaagtaaaaatggttttcatttaaaaaaaaacaaaaaaaaactagatagtttagtttacaagttgaacaatcccactagtattttttcttgagacagccattgtactataatggctgtacaaatgattgtaataacttatgttgtttcattaaaggtgtacttagatgaaattggtggtgaagatcacaatagtaagtgaactatcacttactgatagtttgatgccactaacttgattcatgctaagtcactagcagttttactcaccagtgcctttgtactatcagttgtcaatataataaaaacagcaaatgtcctaatattattttttaaatagtttgtccttgtgtattctctgaaatgatttggggagtcctaggggtccacagaccacattttgctaattacaggttcaaagataccttagagttcctctagaccaataccctataagccccttactacatatgtttctgtgtactgaggtcattattaatgtatttggtaagtatttcataaatacttggctagcaaatgaattcagatcagtattattcatgagcattgtctgtttacaaagactgtctagagtgagattggtagacatagtataactataccatgtacttggcgtccttcattacaaggctgctacacttcttgcctcatggttatagtcttgcaatgaatagtcataactggctaaataaaaaagagagtttgaacagataataaagttaccagatggtattcttcatttctgggggcaaatagcagcaatattagtatgctgaattgatcttcaattcaggtacctgctccagtattccttgtaaatatcttctagtaaaatataccgaaatatttagttttaggttataatgctgagcatgcatacaatgccgaaagaagtgaagatcaggagcaagaaactaaaattgtttgtattgtagtaactatgtctacagtcgaaaccaaagtctcccagatgtttcttgtgatactcatttagtctccttgtgcacagaagttgttaactggatctattagtttcatttatcagaaagtttggttacctcttttcttattactgtggttaagggcttccatagcaagaagacaaagaaaaatgatcaagaaggaagacatgaggaacaagtgccattttaatgaaaattaaacctagcaatatgagataataaggaagtcataaggaacaacatatttatttaaaacccagaacaaataaatatgaattgcttagttacattcatttattgtagaagcagattcagtattttctttgattggctttgtgtttttaaattatattaccagtgtccttttttttttcaaaatcatttccaagattgatcatttactctgtttactttttaaataactcattttaagtagttcctaccagaataatttagtagcatgtattggcatttctaagactttttttttttttttgaaagagtctcgctctgtgttttattaatcggttccaagattgagcatttactctgtttactttttaaatgactcattttaagtatttcctaccagaataatttagtagcatgtgttggcatttctaagactttttttttttaataactcattttaagtatttcctaccaaataatttagtagcatgtattggcatttctaagacttttttttttttttttttgaaagagtcttgctctgttacccaggctggagtgcagtggcgcaatctcaacccactgtaacctccgcctcctaggttcaagcaattctcatgcctcagcctcccgagtagctgggaccacatgcgtgtgccaccacgcccagctaacttttttgtgtttttggtagagatggggtttcaccgtgttggccaggcatgtctcaaactcctggcctcaagtgatctgcctgcctcagcctcccatgaggtgtggtggcaccacacctagcctctaaaacaattttaaatgataaaaaaaacaaaaattcattgagtcttgattgttgtctttcagcatcacagcttttttttcctcagtccaggacaaaattttatgtgattccagaatactttaatgttaccaaaagctatttttaaatacttccaaaatacttgaaaatacttcaaaatacatctcaatgtccacctctaataaagataaatccctagtaagaggtattgactcatatctgtgaagggaaacttaacaataatctatgaagtgctttgaaaaataattttgcctaaaagtggtttttgttgattatcagtgaaaaacctaatgatttcaggcaccctgagaaagccctgcttcacaaaatattttcctcattaagctgattgttctctaaaattccacagtgaaagatgaattccttttgttcactgcagcctcgaactcctgggctcaagcaatcctctcgcctcagcctcctgagtagctcggactacaggcatgtaccacctcgcctggctgatttttttgtagagaggaggtcttgctatgttacccaggctggtcttgaacttggcctcaagtgattctcctgtctcggtctcctaaagtgctgggattacaggcctgagatactgtgcccagtttgttatttccattttatagatgtggtcacacagttaataaatgggtcagaactagtattcaaacccaactacacttgaactccaaagcctaggttgttaatcaccactctttttctttccttggcttctgagatactactctcctgggtttctcttccacctcagtctctatagttccttttccttgtattgttgatgttctacataagacccttcttattctgtatgttctccctatggaattacatctactctatggcatcagcaagtatttgtacgttaatgactccaatttgtatttctgaaccagatcttactctagagcctatgcatccagtttgttcggagagcctcttactacttgaatttgccacctgtccctctacctttattcataccttaatgaatagcattattgtccatatgattgcctgaggcaaaaaagtggagatcattcatgactcctcccactgctacctgagtgatctttctggaaaacataactaatcacatcataagatccttatacctcttgggtagctttccatataaaaggtgcttagcatggcacatagggccttcgatgtcatgccctacctgccttttaagcaccagttctcatccattttgtcctcttacattgctcttgtttaaaatcttgaaattttgtttgagctgtgctatggggaattaaaagtaagcttagtcttacatagtatacatcagtccagagtattagtagtaaaacaacacccctccagaggccactatgttggcagcagcactaactagccagaagtcccctttgggaaaggtgactttcccagcaggaattgagactttgatacctaagccccttatgcagattctcccttctttgccaaacttggaggttctgggtttaatttgtgttagggaaaatgtattttttgtaagccatctggactgtctactcattaatcctccctgtgcctactccagtgacctttctaaaatgcaattattacgatgtctttcctttgcttataggccctattagttaattttaaataattttatacattgtaacattgtataaatatgcttagcattttaggtatttttgttacttttaaacgcgaagtgagatttagcttttgacaacttataattgtttttcttatattttcaattttgaaaggattgtttctttaggaaaattttgaagtattagcttactgggcatcagaaatgttggctcatttatgtaactttctctgtacaactttaaacattaatttgcttcatgcaattaaacatatagaagacttttttaaaaagcagtattgttggacatttagttatttcagcagccattgagttgtctcattctgaaaccacactcggtggagattataccactgagactttttaaagtgcatgtataatctatacatataccccacaaccactctccagtgaagtcttccttctgttttctagtcaagaaagtgtcactaaaattttcaatatatattttaaaaattaacagaaatgggtaagatacttagatcatattgtttctagctctttgtaaggaaacattactaaaatattttcctcaaggaaaatgatagaccagatgagtcttgatcttgtttagaaaccaagtagattgttctataacatgttcttagataaattatagtatttttctattagctcttaggctagtcacttatttttattttaggcgatgcaaaaactttctggatggagctagaagatgatggaaaagtggacttcatttttgaacaagtacaaaatgtgctgcagtcactgaaacaaaagatcaaagatgggtctgccaccaataaaggtatgaagcaataaaaactttgaatatgtttaatactaaatatttctctctgacagtacagtatcattctatttccaatattgctgtttgtaaaagtagatggatgtaattacttttgaataatacctactgaatttctttttatctcaagctacttttttccctcatttatctttttttttaggggaatgttgcaaaagtaacatctgctcattatataacatttggcacttatagaaaaatataacaaggaaaaattattccacattcagagacaactagttttttcatatgtatgtgtaaaagtacatataactttattttgcctgctttaaacagaacttactctaccagtcttctgaaagcaaaatttgtgttctacataggcagttagttcagtaatccaagtttttattttttctatttgtttgttgtcaaccctggttggttgtagaacgtaagacttgaagatgaaatcctccttcaatccatcaggacatacggttttgaagcaaatttttctccagattatttttagtactttctggatggtcttatgacattattattatgtgtttatcaaaaaaaattggcactgtttttcattttaatcttccttgtcaatccttcatgagtcagataaatctagattctaatccagttgtactacttcttagctgaatgtcctggaataaatagcttaacctctgagcctcagtttcttttgtctctaatgcagatagtcctattaacctctcagaggaatagtgaagattaaatgagataaaatatgtaaattgtttagcacagtagctggcaccataaataaaggtaatggtgatgctgtttttctgtctttaacagaatacatccaagcaatgattctagtgaatgaagcaactataattaacagttcaacatcaataaagggtatgtacatctctattcccattgtagagtattctctgatattttcttgccatgaagcaggatagctttaatatgttgggctaattaaagataatttaaaataaaatctaacatccacatttctaagttacataaatcacagtttcctctgttaaatgaaaagtcctacccatctagagatagtaaatgcacatccaactaagcagcctagggaaagaattaacaaatgtgtgtcgtctttgggggaaaaaaagactttcttatataaagagggcaaatagaattctaactttaaaacactatatatccgctttctgtgaagaacaatacttgaaagatatattcttgtatagataagttggtgggtaaatcttttatttctagattgcttttagaccatcagtcttccaagctctaaatcagcttagaaggatcaaagataatgtactaaagaaaaactgtttctcttctcacaaagcttctgacaccaaatgtgggttttccatgccatgcaattctccagtattctgtggacaccaatggatgttgtattctaaaatttaattcagttctgacactactacccagagttagcacagatcccacagattaagggctcattcccaccaacttgctcccacttcagacactggtcacaatgcctgggcctcctgtacttctgactgactgctacaaattagaggttcccacaaccccctcctcagattccatgatttgctataatggcttatagaactcacagaagtatttactattaccagtttattataaaggatattataaaggatacaaatgaatagccagatgaagaggtacaaagggcaaagttgggaagggcctgagaacaggagcttctgtccctgtggagttttggggtgtaccaccctcccagtatgtagatacattcaccagtctgaaagctctctgaaccctgttgttcaggggttttgtggaggtctcattacataggcatgattcagtcatcagcccattggtgatttgcttaatctgcctctttctcttccctggatatgggggtggaaagagtagggatgaaagtgcgaactcattaaccatgcctttgtcagaagtgccttggtctttctgacaaccagcccccattctgaagctgtctagggatagctcacctctcaacagtcatctcattagcatacaaaagacactcttatcactactggagattccaagggtctcagaagttcttatgtcaggaactggggattaagacaaatattataacagaaggtgctcctctcatacctgttacttgaaattagaagggttttaggaattaggtcaggagccagggcagaaaccaaatatgtatttcttatgatgttacatgtactaagactttaaaaagaaaaactgagaagttattttaacaggatcaatcaccattccataaatcttagtctgtcacatttgctgaagttttaaggaagtacaatatttactaggtttgtattaatgctgttagatgttgtcaataaatgtcaataatttttgtcttttataatttggagccttaaggcttttaaatctctgaaaatatagtctagcatcaccagtctattttaagtaaaccatttggtattcaaagtatcctcaatttcagtgctacagtatagctttagaagagtagtttcttgaagaaaacagtcttcctttcacagtatccttcagtaacactcggaattgtaggggaggaaaaattttatctcagtggctgggggatgagggctgtaacaaaagatagaagacaggttaacaggagaagagacataaacaaatgtgttaatttttttttctttttcttgagacgaaatcttgctctctctcccaggctggagtacagtggtggtatctcagctcactgcaacctccccctcccaggttcaagcaattctcctgccccagcctcccgagtagctgggactacgggcgcatgccgccacacccggtgattttttttttttgtattttagtagagagagggtttcaccatgttgcccagactggtcacgaactcctgagctcaggcaaactgcctgcctcggcctcccaaagtgctgggattacaggcgtgagccaccgcgcctggtcaacttttaattttatatgcacaagtgttgcgggaattaggaggaccagagagaccttcgggtgaatacaggaggatctttattgagtgcactcagacccagcagacttaacatccaaaaacttggcccagaacaaagacagcacttgacttttatacacaagggggtgggctagcctgaaacaagcttacagtggcatgaagcgtagtggcatgaaagggtacagaggcagaacaaagacagttaatcaaattgtgacaggttcataactcagcattacacgtttgctatgcagcccagatgtctgttatctaggtttttctctagtgcctagcacagcttattccatgaccttcactgtggtgcccaggtggccataattcaggcctgctcagatggctcatgaccttcactccaccactgcttagataaaacagaatacttgaagttactagttacagagaacaggaatctatacactcataccataagagaaaggaaaatttgtttttctcctctctatgttgagggagtgctgggagagtcccagagcacattcctttgtgtcctggcttcttagatagtattaacaagactttttctgggtctgggctgtgcctattgctgcctctgggataagtcatcctaatacaggaaagcttatttctctttttaattttatttttctttctttaattccctgcctcacaggagcatcacagaaagaagtgaatgcccaaagcagtggtgagatttgagagcacattataccaccctaataggtgaaagggaggagcagaggggcacttctggaagaacacatgacttcaaagataaatgggtcctatgagaataagtgaaagatttgtaacagtgtctgtctgagtatagtactgacttcctctgctctccctgattagatgaaatcattcctggttgatgaaacttctgggaggggatttatgacaattgagtttctttttgggaggatcgatttttagacagataagggaactccagagacaacttcttcctgtatttgttcattctcagatgtcttcaattcaaaataatctttatgttactatatctcatctggacaatccttaagggattatatttagttttgcaagagagaggcttttaacctcacttgttaccaagaaaaatggtaacaactaattctaaacatttcttttctttctgaagaacctttttttccgtaaaaagtaagttggtttttgtttggggtcttttaaggaaataattttatcaatagaaatgccgaatattataatttcatatttttatgtagttggtccatctgaaatgtaacaaatgcatcaagataagagtatatttatttgctagcagtgaagtgtttttaagtaaacagttggggagagttatgtaactgacactgttggcaaatgtaaggattgaaaacctttggtaataaaggttcatgtgggctgaatacagtggctcaggcctgtaatccaagcactttaggaggctgaggtgggaggatcacctgagcccaggagtttgagaccaacctgggcaacacagtgagacctcatctctacagataataaaaaaaaaaattagttggctgtggtggtgtgtgcctgtgattccaggtactcaagaggctgcagtgggaggatcgctcgagcccaggaaatcaagtctgcagtgagctgggatcacactactgtactccaaccttccagcctaggcaagagagtgagaccctgtctaaaaaaaaaaaaaagtttcacgctagcatttattttaaaaagaaggttgggaatgagagaaacaaaagaactttgtgttgaggtcaaaacaagctgtcctggatccaacctagactccccaggctgtcatcaaaccgctaattatgtttatttttcttgatgttgtgtaactctcagtatttgctctgtctccatatgaaggactggatagtgttttcttgagagaaattatttccctttcctcttttttctaatgactaatgttaaatcctcatgtttttgagtaaatcctatttccaactatgcttgatatacatttgttttgttcatatttgttaatatagatttatataactcatgcaaataaattagctggaggaaaagtcagaaactcttattatttgtaaaattaatttctaatcagttatagctgtgaaccaaaaataatcaaaagggtcagaatctaattttttttttttttgagacgaagtctcactcttatcccccaggctggagtacaatggcacgatctttgctcactacaacttccgcctcccgggttcaagcgattctcctgcctcagcctctcgagtagctgggattataggcacctgccaccacacctggctaatttttgtgtttttagtggagacagggtttcactatgttggccaggatggtctcaaactcctaacctcaggtgatccacccgccttggcctcccaaagtgctaggattacaggtgtgagccactgcgccccatccagaatctaatttaaagagagtttattcaggtgcaaagtgtaagggtagccatctgaggaccagtgctacaccaaagaatactgataagtgcttctggtgtgggagaaatgaggattatttatataggcaaaacagaggtgttgaacaggattacagcatttttgtacaaagggtaacatacagatatttgattggctactgttgattacactctaagtgggttgtccaacattctgttgtaaacaggtaacagtcacaagggtctctttctccatatcatttagactaggtttgaataaagaatagggagtcttgactgggcgtggtgtctcaggcctataatcccagaaccttggaaggctgaggtggcaggatcacttgagtccaggagttcaagaccagccaggcttgaggtagagattctacctctacaaaagaattttaaaaatcagtcaggtgtggagttgcacacctgtagttctagctactctggaggctgaagtggaagggtagcttgagcctaggagttcaaggtcacagtgagcttatgatcacatcaacgtactccagcctgggtgacagagcaagaccttgtgtctttaaaaaaaaaaaaaaaatgtggagtctagttaatgtgtaacatctcaacacagaagtcagaaagcaatggtcatgcaccaaagaaaaaacaatcatgttacatgagtcctctttcagggcttaacttttccctttggcataataaatttggaaggtcctaaatttttattttctttttacatagctctcttcaactatcagacttttatttattcatttattttagagagagggtcttcctctgtcgctcaggctggagtgcagtggtgcaagtatagctcactacagcctacggttcctgggcttaagcagtgtttccacctcagttcctaaatagctagaactacaggcatgcgccaccatgcctggctaacttttttttttttttttttttctgtcgtagagacagggccttgttctgttgctcaggggggccttaaactcctggcctcaagtaatcttcccactttatccttccaaagtgatgggattacagggatgaaccttgtgcttggctcagctatcagattttaaacctttctttacttggaaaattaaagacagatatttgtttttcagttagccaaggagcaaccttgaaatacaatatccttttattaaacttcttttgagggggaaagtaagttataatttttttattagaaaataaatatactgggccaggcatggtggctcatacctgtaatcccagccctttgggaggcccaggtgcacggatcacttgaggtcaggagttcgagatcagcctggccaacataaaatcctgtctctactaaaactacaaaaattagcccagcatggttttgcatgcctgtaatcccaactactggagaggctgcggcaggagaatcgtttgaacctaggaggtagaggttgcagtgagccaagatcataccactgcactccaccctgggcgacagagtgaatgagactctgtctcaaaaaaaaagaaatgtgaacaactagatcaaaagagatacccagatacttcatcccctccctaaaatagttgtagagcaataggaaaacaaaaggtacataaatttttcattttctgacttttatagagcctttaagaattatgtgatttctctataaaatgcatgcagaagtagggatactcaatgtccaccttaaagattggttaagcttcaaatcaagttcaggccaaactagagtttctacagtagaaatcttttctgtcctcagtattttatcctagtttattcatatttttgaaaatattgacacttaatcttttgcctcaatcttgaaaccttactatgtttgcaaattttagggatccatatgggcagactctagtcaatgaacatattacttgggtacttatagcaaatggtttttaacttggtatatttgttgctcacattatttttttgtgtagatcctatgcctgtgactcagaaggaacaggaaaacaaatccaatgcatttccctctacatcatgtgaaaactcctttccagaagactgtacatttctgtatgtatataaattctttgttattaatgcttttgctcctacagatttcttctttataaatcacttgacattagaatagatgaaatatacaaaaaaatttttcccattaaagctttaaaagttgtatattttagtattttatgtaagatagaatttcatgagtctctgaataggttattgaatattcctagttaatcaagtctttttataaagtttagcttaagatgtctttgtgtattttattaatacactgaaatctaccaagtagtgtgtttttgttttgttttgttttttgttttactgcttagattatctggagaatttaaaagtgtcaaaatgtttctttcagtatcagttgagttttcaaaatgcgtaacagctcttaagtagtgtctaaaagtttatgggaatagactaaatttttctgaccttccctttctcattttatcattactttccataaagattctttggcataaaggagatgtgcggaagagtgaatctagatactctgacacgtagtctttatttttagtaggtaatacctgggcctaacccttcaagtactaattacagggaagtttctgaaagttctctagagtagagaacatagtttcaaaaaacaaagaagtatctttagaaagaaacttctttgttaccctaatttcatttgttctttcagcttaatattaaattgactaagaaaaactatataattatttttttgattttcatgcctgtgagagttgtagatagacactgtttcatataatttggatttacaaatattagagatgtcattgcagtttgagtgggtctcaaaaggcccataaaattactttaaaatgctcacagagaaagctaagttcacactttagctccttaattggccatttcagtggctcacaaaacatttttttttctagaaattctgacctttgaatatacagtgtaaaattttgtaagtttttaggaacaaattcactcagtctaaatctaaattaaattttcatgtaaattaccaccaaacaagctctctaccaaacagttatctatatatttagatattatattttaaacttaaatgcaggagtggtttattcctgtgaagtatcattttttgctttaagttcattataccagcttatcagaatctttttgaattttggaatattttttgtcccttttagcttatcatcttgtacaaataaataagctttctaatcttcattatggtcactgaaaacaatattgaacaggacatgaccaaagataaaaaccttgtggctggctcactactagacattctttttattacgcttcagaaagaacgctttaagcaactgtgaatttacttctactgttgtcccgcctacacttctcacttacaaagtggtcatgaaaaatcaaggttcactgccatagcattctgtggcattgccagacattattcagacttattgaaaacgttgtcaaaaaagaaaattcagttaatttggatttttctcacctacttgttaactcagcacctagtgttggttggccttttaaattcaaaatatttagaagccacacccttgatgccttcttctagagatttttaagagaccagtgttaagctaacctttctatattttctgtagcctgtcctccttccctttttaaaaatcagggcagctagaacttgaggataagtggtcaaagaaaaaatcagggcagtattattttatttttaatttttctatatttgaagtttttttttccagaccttgagatttaatttgtagagtcttctatatgcttaaataaacttgagttctagtaccctctctttaactgtcacagacttcagtttctttttatttttttcctcttgtttccaacttgagagccatacttaaagatggaaaagacaaaggcagaattgtttttgagaaactcttccttctctttgttatcagttaaccttatttttctcctaacagattattttcttgttctaagcatagctttagttgttttttgttgttgttattttattagcacttttggaaacctcggttcttactaggctttgtgatacttttcttacagtttcgtaccaatgttgcgtattcataattagctgtcttcttttgtatgtatacttttaaaaatccgagcttccaagaaaaattgagttggtttctttaactgttttcccatctctttaggactgtttatgattatataatcagaatttcatttccttaatctcccatctctcttgtactgtgttgacactcagaggctttttttgagattatacctaacttttgagttgagcattctgagatcttttcagatgaagggacatgtcttattaggcttaggattttcttcctttgccattaagaattccaaggaagcatttcattcttgactggaattatgtttaaataattccttttatatttcctctgcaggccagaagtttatttgcttattttattttcagtacttaaaccctcttagcagcccagtggtcacataggttgcctagtaaactaaacattcaataacttaagccaggaattcttagccccagctaaactgctcaagattaggctgagcatggtggctcacacctgtaatcccagcacttcgggaggttgaggcaggaggatcacttgagcccaaaatttcaagactagcctgggcaacatggcaaaaccccatctctacaaaaagtaacaaaaattagccgggcttggtggcacatgcctgtggtcccagctacttgggaggctgaggtgtatcacctaagtccagaagatcaaggctgcagcaagccatgatcgcgcctccgcactctagcttgggtgacagagtgagaccctatttcaaaaaaagattatacaaactatcaacggcaaaccccaggatgaaatcttgggtctaataggacacaggcttcaggcttttggtgtttttttgtggggtttttttgttttctttctttctttcttttttttttttttttttgagacagcagggtctcactgtctcgctgggtggactgcagtggcacatagccacagctcactgtaggcttgacgccctaagctcaagcgatccttcctcctcagactctcaagtagctaggactacaggtgcataccaccacacctggctaatttttaacattttttttttttgtagcgatgtggtctcactatgttgcccaggcaggtcgtgaactcctagtctcaagcagtcctccctcctcagcttcccaaagtgctgggattacaggcatgagccaccacacccagccagtattctattcttgagttgaactgaatttctactccacataagtgagttatgacataggtaaatgtaaaaacaaaagtattacttcagtgataattcttttaaaaggatatttacttttgtgattttagaagtctgaattccctttttttttttttttttggtcaagtataaactttggtttgtcaggagtacatacctattcaagctagcttaagtagtggaatttattagaagtgtacgaggtgtgcagctttggttagcatactgggtgacactgggcttgcaccactgcttaaagacacaggtgtaaatttaagccattaaatttttatggctttttacatgacatgcacacaaacccaaaagattatttttaaaaacatgcacacacatgtacctacacatacatacacacatatataaataaaataggtcttgaagaacagaaaatgtaacacagcaggccatgtaaacactaaaataggaacttaaaagtcaatacctaaggtcagggttgacacagtctcaactctacttctctctgttaccagtaggtttcttctcttcccacatgaccaaacatagctgccccagctaaactctaaccttctagtgcaagtgttatctcatgtgacatatatatatatatatatatatttttttttttttttaaatagagacagggtctagtcatgttgcccaggctgatcttgatctcctgggctcaatgaatcctcccacctcggcctgccacagtgctgggattacaggcatgagccaccgcacccaaccattttttttaatatcttaatttaaattattgaaagagacagtataaaaagcccagtatgtatacaagacccaacatctttgagtacactgaaattaatatacctgcctttcagaagaggatgactaaagaagggactgagcaaaataccagatttacctactgcagtctttagatgaatacagtatacattcttgttttaaaatatgcccccttaatggtcatagaggatagaatgacttcttactttagccttgccaaaagctagataatcagttggcagcctctaagccatgctccactttgatgttcagagtgactaacaacaccctgaacaattgtcaaatcatatgcaaactgagaaatccttacccagaggctggcaagcaggtccagacagccgtggacttctccttctcactacttactccttatcctgtgtttacctctagcacttttaatcaatgactgggtttacaatactgtgcatagaattggttttatttctattttttttttcagtaatgtatcttcacacctaaataaagttaaccctcctctccataaaattgggatgaaattaggttactttatacttaagacttgtaagttgggttttttccttctctttagtaaaatgaagcacagataagaaattaatcttttctaaggttcacactagtgttttatttttatgcttttctcctcctcttctgtttttttctcttctcctcccactcctccctaactcttcttaaatgtaaaacatgtatttctcagtgttaattgctcagtaactagagtcttgtatctcctagtttttattagtcataaggagaatacttttaatctagtttggctttcttgaaatgtaaattccaaattacaagttttaccagcatatttactattacaaattttagtcctaagtagttctaattgtatattgttccagtagtggctaacttggagttgtatttgttgtgtcatatgaggaaattatgtaaaggacattaaactactattcaaatattagtagttacttaagaactaaggataacccagatactttctctctcacatatatcctgaattaatcccttcatattccaagaaaaatttattgagtcatctacattaatatttaatgttccccttcctccaaagagcaaaacaggaaccaaaaaattcatacccgaggccaggtgcggtggctcatgcttgtaatcctagtactttgggaggccaaggcaggcagatcacttgagctcaggagtttgaggctagcctgggcaacatggtgagaccccatctctaccaaaaaagcaaaaaattagctgggctttgtgacgcatgcctttcgtcccagctactcgagaggctgaggtgggaggattgcatgagcccaggaggcagatgttgtggggaaccaagattgcaccactgcactccagcctgggtgacagagtaagaccctgtctccaaaaaaaaaaaaaaaaaaaaaattcataggcaaaatgtcaaatgacatttacagaataatatactacagaatccagtttgaaacatatttatttggttaagtcaagttgaaaaggacaacagaacagtttactatctctataaatctgtaagtgtataagtaacttgagagtgagtaacctatatcaaaacaaagaacaaggccatgagaacctaaggaatgtattacagtgaattctgaatgaaagaaaatagggtgttttatctcagagagacaaataaatagaaaatccagagttcaggttataccataattccttataagaaaaagtggtaagaaggaacttgacacctaataatagggaacaagtaggttccaggtaccacctttgaaaaacaggaagatactggatactaaaataaatcaagggccaggcatggtggctcacacctataaccccagcactttgggaggccgaggtgggtggatcacttgaggtcaagagtttgagaccagcctggcccacatggcaaaaccctgtctgtactaaaaatacaaaaattagctggatgtggtggcacatgcctgtaatcccagctacttgggaggctaaggcacaagaattgcttgaagctgggaagcagaggttgcagtgagctgaggtcatgccactgcactccagcctgggcaatagattgaaactcactctctctcaaaaaaaaaagatttctaaataaattatagtatatccttttacctgttagactctgaaatccaaaagcatcaagatccacctgattgatgaaactctgtgaaaacaggcactctcatttattgctgaagaaactgacactatggagaacaatttggcaatattaatgaaataactaacccatttgccttgtgacctagcactcccacttctgggaatatgttctgcaacagtatctaacagtatctttacgtgtatgaaattgttattaatagattcataattttatagcaaagattattacaataaaattacttattaaaagatcactgtataagtttactgtatacgttctaaaagatcactgtgtaagttaactagtccattattgtggtctagcctatactacatgttatggaaaattgtccattattgcaggctaggtaattaaattgtggacttacgcaaaggattactatacagtcggagaaaggatgaggaagctccatatctgcacatccagtatggtagccactagctgcatgtggctgtttaaatctgaattaatcaaaattagataaaatgtaaaaattcagttctttggtcgtgctagctacatttaaaagtgctcagtaaccacatgtgcccactggctaccatatcggacagcacaggtatagaccatttctatcaatggaggaagtttttttggatggcactgctttatatagtgtattagtccgttttcacgctgctgataaagacatacccaagaccaggcaatttacaaaagaaggaggtttaatggacttaccagttccacatggctggagaggcctcacactcatggcagaaggcaagcaagagcaagtcacatcttacatagatggtgacaggcaaagagcttgtgcagggaaactcccccttacgttaccatcagatctcgtgagacttattcactatcacgagaacagcacgggaaagacctgcacccatgattcaattacctcccaccaggtccctcccacaacacgtcggaattcaagatgagatttgggtagggacacagccaaaccatatcatagagcaaatacaacgcatctctaaaatacctgtattataatacataacagacacctaaagatagaaaattctatgtaaaacaaaactcagattatttgtgaaagtttaaaacttgatttccaaacaaaaggaagcttttcacggatttttttttttttaagacaggatctcactctgtcacccaggctggagtgcaatggtgtgatcatgattcactgtagcctcaacctcccgagtccaagtgatcatcccacctcagcccccgaagtagctggaactacaggcatgcaccaccataccttactaattttttttactttttgtagggatgaggtttcactgtgttgcccaggctgatcttgagctcctgagctcaagcagtccttccgtcttggcctctcaaagtgctgggattacagttgtgagccatcacaccctgccgacttttttttttattttattaataaccaccccattttctcctatcagtttgccattttttcagatgtatcaatatgattgtgaggtagattacatattatggaaagaattaagttggtactattgttgaaggcaaacagtataaaggattcttgatgaattaataagttttcagccagcctttgtttttttgcatgcaaagagcttgatctcagcatgcctgaagaagtaaccttcttcagtgctttattgattcatgctctaaatgaactctaaatttgctaggtgctatgaaatacctaacagaaagttacagctgtaatcacaacttcctggaatattctgaaattaggtataaggcagacctggtgcgtgcctataccagctatttgggaagctgaggcaggaggatcacttggggacaagagttcaaggctgctctgtgctgtgatcacacctgtgaatggccactgcactccagcctgggcaacataggaagaccccatctccgagaaaagttttaaaaatagatataatctttgtatggctgtagaacatcttaaaatgtgtatcttagagtctggcttattttaatattgtctaagaaggtagaaaataatcatagtttttttaaaatgaggaattgaactataaatttgagatactaatgaataatttattttaacagaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacatgtgagtagaaaaacatggcgtttcaaaaaaatcttctgaatgtaaggacgcttgttaagaagtcttgctatgtattaatttgtctatctaaaacctgttcaagagttacagtaagactgggcgtggtggcccacgtgtgtaatcccagcacttttgggagaccgagtgggaggccagcttgagcaaaggagtttgagaacagcctgggcaacatggcaaaaccccatcttaacaaaaaatttaaaaattagctgggtatggtggtgtgcatctatagtcccagctactctggaggctggggtgggagatctgcttgagcccaggaggtcaaggatgcagtgagctgtgatcacacactgtaccagaggcctggacaacaaagcaagaccctgtctccaaaaaataaaaataaaaataaaagagtctacaatgggaaaatgaactctgtcactagcagtaggaaaaaaaacctctaattatttgccaaatatggtaatttgaaacatttcttccaagaatgcatatttcctttaatctagtactaatacattaaaagataatcaatggcattacaacaaatgatatttaacagtgccagacactgtgacaagtacttcacattcattctcttaatcttcacaaaaacccatgaggtataggtaatatctcagtgttatacatgaggaagttgagcctcagagaagtcaatttggagaggtcatagaacaaattgtagagacaggatttgaacccatgttcttaaccattgggttatatgttgcattttacttttaaaaatcatttgctggctaatgtgatgcttataactagtattttcttaatcatagaatagtattaacatcccatgaaaaaatgaaaacatgttctaatatattaagactttgaaaaacattttaagggtgtgtagtacacatacattcgtaggtatacagatgtagagtggtgttgcattatatgtacttttaatttaatgcaaatttagctacccatacttggcaaaaaaagaataagagaatgataaataatttaaatagtataataatagttttcaccatcctctaagttaattggagtgtaaaatgagagctatatctactgttacctcagtttggctcagttccttgaggcctctcatagaggaaacctctcactgtgctgttttattctgtttaaaaatatgtattttattttgtaaagattacctctaaatgtaacccaactacctcatctggggacttggctcttcaaaggaatagaaacaggtacctgcacaagactaggaactaggccagtatctcacagggcctggaattgtattaatgaaaaccttgttaacagctgtaaaaccaatggggtcagagccaaagcgttggagaaagcacccaatgtagagcagcacacaggactaaaccccacagaaggtatgatttcaaacaaacatttacagcacacaaagatgtttaggaccatgaaggcagcatgagtcccgacaagtagagagaattaacacctgaggaatcagaggtaaatgttgaatctaattgaaagggattttaaaacaggtataattaaactgtcccaagaggctgggcacagtggctcatacctgtaatcctagcactttgggaagctgaggtaggaacatcatttgagcccaggagttcgagaccagcctgagcaacctagcgaaaccccatctctacaaaaatacaaaagttagcgtggcgtggtgggacgcccttgtagtcccagctagtcgggagtctgaggtgggaggatcacctgagtgcagggaggtcgaggctgcagtgagccaagattgcgccactgcactccagcctgggcaacagagtgagaccccttctcaaaaaagaaaaactatgaattgtatatgaagtgagcaatacctaatccagtagaaaagttaaaaggaattaactagatttgtatatagcatggatgggtctcaaaaacattatattgaacaacaaaaaaagcaagttatagaataatacctatagtaaattttttataatgaaaaatacacaatatattgtttgtagatacatgtgtatataaaagcataaaggatgccacactaaatctcttgagagtttagttatatctatgttttactttttaactttttttaagaagaccatatatatgtggtgtatatgtggtgtgtatattttgaattatatatacagggaagagaactagacaaaatgctgacaactaattctggatggtggaaatatgggtgtttattattatctgtatttttctgtactttttaaactttgcacacaaaatcacatgggaaagaacaattatagattttcatatctgtaaacagaatccaaattaatgaatttgttgattgttgtcgttgttcttttctcttgcaaacagcagccaccattctgatgtgtattaattaatacagaaaatacagaagagaatcatagaggaaaagaccttaaagtcacttgttcagcaaaggagactaagatccagagattttaaccagctcaccagcagtcatttacctagttacacagctagagtccccaagttccttactttgtatcaaattatggttccctatcaagttagttagtcatctgaatagaggggaaagtacatgaagttttatggttgcaagcttcctgcctcgcaacagtatgaaaaaaggattcaataatagtaggcagatacccggcatcaatctccccagtctgtttctgtcactggagtgagagagaacttaagacatctgcaaaactatgtccttacaaatttgacatatttaagtttatccattgtaaaagagcagaactagcagaattctcacaaacaagcttctgtgctgaacagggaaattaaaggaattgattttggaaagctaaactcatatagttaagtatttcatgagcaaatagagttgcagtgcagtttataattatttataaacttttgggaggtattgtctttcaaagagatctatttagggaaaaagctgatagtgttcatgagccaaactattctaaatgctattacatcttttattacatcatttacacatttatcaagacagtctcttgacttgacttgctgctttttcattctttctccatccattgcctgccttttagaacaaaatgtgcatgtcttcaactgacagcaaggaatgccaaaacttcccccttgtcaagtgacaaaataaccactggatataaatataaaagactacagagacagattcctactgggtaaggtaccttgaggatttgttgcagggtgtgtatatctttgaaggtgggtactttttattgtggtccaaaatcttatagatgttaaatctggtttaatttggttctaataccaaaaatctaaattattaaggaataaaaatcctgtgtattgttcgtggaaatggtagtcagagaccacacatacatcatgcagagtgtacttgaacactcatctgctttgagtctggctcttacccctctagtatcagcctactttgggcagccatttctccgtttaaaaataactgtctagaactcatttgagaattgggaattttcaacctttcaaggtactgactcacttaatcttcacaaagcagccctatgagggaggtattgtcatataatccccattttaaaaatgtgaagataaagcacagaaaagttaaataactcatccaagataatacagctagtaaatgtggaagctgtgatgggaacccaggcactctacctctaagagctttcacatttagcctgcttccctcagtagttatcagtgtcagtgaagtgtcaataaactgctttttgagatgtctgattttctcttttgcatattttgttgacagcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggtaaagcaaaagtttattttcaaattattctagagtagaatccacttttctaaatatccattttcctagccagggctgttgagagcttacagcaaggtaaagagtaacagtatctaagaggaacatcagagaaaggcaggtaaactgggaacttgagcactaaagagatgagatgcttaggaggtactttcttcaagaaaagaaaggttcagagatgacacttgggtttttgtgtgagggcctgttacgtacaaggcacatttgttttgtctgcatggctacaggtactttggggtaagggaataaaacttgttaaaagtaaaaaaaaaaactaaatgactggcttgccaaggtaaagatgaccagtcaaaaactttcttattcaatgttttgagctattattagaatttaacaagttaattatgtaatatctgcatgttataattcagtcagtgactttaggcaactcactctattttggggactgcagagagttgtccatgctgcagagcaaaacttcccgagcagtgtgttacagtcatgcaattactgattctttagggccacagcccccagggccaaacacatcagtcttcagtagtcttacacatttacctccagcatgtcaggcaaaatcccttattttctgtgcacatccttctgtgagaaagtttgggaaacacggctttagagccagtctaaaggaattgtccttgacttattttagcagttaggcatcagggaaaagaacaaccaggttctgaaaattactcatctgaaaaatcaggtttaatctgtttacatgaccatgtgcttagaaaagaaatatcaggttcacatcagggagggcaagaagaagcttgcagagttcagagtagtcacacgtatggatccctgccactccccatttacagatccacattctacacatcctgcctagacgttcatctctcatacttctcaaaataactcttggatgaaagctacctgtaaaatgccaggtggtgtccaggaagtatcattggttttatcgttgttgctggaaaatgtaactaagatatgtctccgatctaacaatgggtaagaatatcctgctattaatttggacttggcaactataatattgaatcccttgaaagaaaatgcatgaactttagaccaagattttagtgttatgcagaacttaatatgacaacactaagaacatatcaccacatatttaaataggtacttttgttaaaaattttaagtttcagatgataacgcctttttaactagacataaaagctacaattttatggctagagtcatctctctaattttctagagtactttctcatccatatctttttgtatcattctagctaaatctcttctcttttgtattataccaaaacagacaaatggtttttttttagataccctgttttttcatatactggaagataagaaatatcacattggtctttgtcttgcaacagttttgtaggatgagttaatgtgtttatcttcattgtagaatgtgtgggttctttagtcatggagtagaaatagagatgtctgtttatcattagcaattatcttctgtgttgttcaaactctttaacattttccttttaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtgtaagtaacagctgaggaacccagagtaaatctaaattattatcaatcaattggttctttttcattccttcccctctttcttttctcctcatttgtatttatcattttgcttcaaagttgttaagtctaacactttgagaaatccaggacatgtaaaaatctagccaatataccatcctcagtgttccagttttggaattttaccttatatgactttagtcaggttttttatggatgtcataagttttgctgttttttaaaattttctatcattttatctgcaaagttttcataggttctcttccttttccaaatgtacttcaaaaattatttatgattatatttcctttctctagggaaaggaataaacatagatgttcttacttaggttaatttataataattaaggatatttatgtaataatggatattatctgtacttgagtaaagagaatgaagagaatttttagtgatacagaataacttttttttcctttttagggaaacgaaatatgataatatttcaagaattcaatatcattcagttattagagatcctgaatccaagacagccatttttcaacacaatgggaaaaaaatggtaaaaaatgcaaaatgtagttgggacccttcttttcttttttaaatttttttttttttttttttttttttttttttttttttgacgcagagtctcactctgtcacccaggctggagtgtggtggcacagtcacagctcactgcagccacaatctcctgggctcgagtatcctcctccctcagcctcccgaatggctgggactacaggtgcacaccaccatgcccagctcttatttagtagagatggggtctcactatattgcccaggctggtctccaactcctgagctctagcagctgttgtgcctcagcctcccaaagttctgggattataggcatgagccaccgcacccagctgctggggcccttctgagatgtaaactattgccttcctatcctttacttagctcaaaatgtttgtgttactttatagtgtgtagaatttcttttattgttttggaatggtggacggtggaaatgctaggaccatgttctgtttacttagtatcatccacggcagttgacatgtttccagcttggctgtatgaggagaatgctggtcatgatctgacagtgtgctccactgagaccgagaggtatcccattctgagagtttgtgggagaagctaaagtcttcaggagttaatagtgatatataagaaaagggacaaagtaatttaggtgaaggagaacaaggtttttgttttttgttttgttttgttttgagatggagtttcactcttgttgcccaggctggagtgcaatggcacgatctcagcttattgcaacctctgcctcctgggttcaagcgattcccctgcttcagcctcatgagtagctgggattacaggtgcctgccaccatgcccagctacttttttgtatttttagtagagacggggtttcatgatgttggccagctggtctcaaactcctgacctcaggtgatccacccactttggcctcccgaagtgctgggattagaggcgtgagccactgcgcctggctgaaggttttaagatgtatgagaaagaagagatgcaattttatgaaagaatcatccagaaaacagtattttatgtggtagcctctgagggtaccctttgcattgtgaactaaagattagtcagagactgaaacgtagaagcagagaaagagaaaagagaacaaagagagacataatggtagcttactttagggcttgttgatgaagagtaaaaactctgctttaggtgttatgcaaatatttgccctctgcctggtaatggtacagtagctacctccttaaggtcagagaattatgaaaagattggccatggtgtcacacagacccaggtgtaacctccagctctgctgcgtgctagctgggtggtatctccatacatacatttcttttatctgtaaaaaggtaatagtatatgtttcagaattatgaggattaaatgagataagcatcagcaacttgcttagcatccaactaagtgctcaatacatgttgaccattcacatgctgagaactttcatagtaataatatggtcaatgtgtattgaatacttagttggttgccaagcattgtgctgagtatatacgcctcttttaaagttatcattactacttaaagtgactgcagtgtctacaatgtgtaagcattatcacattcgttaacctttctttgaagtagaaactagccaatgagtgtttttcatctttacacaacttacagttgaaggcaaatttataatctagtaataacactttctaagtactgagatgattagaattgggggatacagacagggatgcattaagattttaattcccaaagaatttcttgacagtctttatagctgtggcttaataaagcacctagaagtagaacagagtcaaaggggatgacacttgttgactccattagtctaaagactccttatgatatcagctttgaggcttttcaaaacgaatctagtacatatagcctatgatgattgacacttgatgaaagaggcctaactgctaaatacttttgcctgacctggaaagtaaagacatcttccttgtttttttaaggaatttgtttcctcggagtctgtcactccagaagataatgatggatttaaaccaccccgagagcatctgaactctaaaaccaagggagcacaaagtaggctttgtttcttctgtgaatgcctacctcttctgcctgtttctctgtctcttgctcaatacctgtagctcattttcttagattccataataaacatgctgcatttgtcagaaaggttacaacttgtctacataagagatcagcaaaatatcgtgtgtgggccaaatctggccctctacctgttcagtatggcatgtgagctaagaatgatatttatgtttttaaatagttgaaaaaaatcagaaggtgataatattttgacacttgaaaattatatgaaattacaattttagtgtccagaaataaagttttggccaggtgcagtagctcacgcccgtaatcttagcactttgggaagccaaggcaggagggctgcttgaggctatgagtctgggcaatgtagcaagatcttgtctcaacaacaacaaaatagccaggtgtggtggtgcacacctgaggtcttagctactcagggggctgaggtgggaggattgttgaggtcaggagtttgaggttacagtgaactatgattgtgccacggtactgcagcctgggcgatagaacaagaccctgtctcaaaaaaaaaaataaaatgtaagttttattggaatacagccaatttacattatatattgtctgcttcaacattacagcaagagttgaataatcacaacagagaccaccacatggccagcaaagcctgaaatatttgctattttgccttctgcaggagaactttgctgacctctggtctaattgccagtagtgacttgatgcatgacaagaggggtgggctggaaaactcttgagtctttgtggtgcacaggtgttgtccgtggctttggaaccattgtgcaaagcagccactttcaaactctttgtagacgcctttaaaaataaacacacatcactttcctgcaattgcctagccaatactgccgcagagcatactcagcttgactctggcaaaaggctaaaatattgccaccctgagtccttgtgtttcagagttactagtccttgccatagttaatattacaactggacaaacattgtttttggtacttttgcatttcactgtgtccttcacaaggagacattgctgagagatatccgtttgtgaagaattggtgagccactgctgtctcttcccccctgcaaccgcagctctccacctaatattaaaggatggagattggaggagacatggcagttccttgatagaaaaggtctatcaaaaaaggggattttgtgtattatatttattttatcatgcatgtgagccacagtgcataccgttgcttttggttcttttgcccttttcattgactgctacaatatatatagcgggtactccaaaagtcaaaagctacatactttttgtataaaaaaatccaaagttgtattatggcttacacgtaacccatgattaaaatataagtacatataggaacagcagccagcaacaacagtgatgattaaatcaagagcctcaattttagacaagtataatttctttgcgccattgaattaggtggtccaaatagctttgtggctcttttaaagtaagtaatttatacttactccatctgacatgcattcatatcttttcttttttttttaaagagagacagcgactcattctgtcacccaagctggagtgcagtggtgggatcatagctcactgtaccttccaattcctgggctcaaacagtcctcccacctcagtctcctgagcaaacaggactacaggcacacacccccttgttggctaatttcttttttttaaaattttttgtagagatggggtctcactttgttgcccaggctggtcttgaattcctggcctcaagcatcctcctgccttggcctcccaaagtgctgggattacaggcatgagccaccatgcccagccatattcatactcttgaatactctcaaaaaattattttccttattggataagaaaaacgattaagcagtgcatctgcttttaaaggattattgtttacaaaggtgtaattattgaatggtcatctagtaaaacaccaaacactaatatgtgcaaaacccctagcaatacagttgtcactgctgggacttgtggaaggtgtctctgtcagggttaggccttttattggcagcataaaggcctagagtgcctccaaaacacccactctgttacatttgtttagaatatacttaagtgcagattccagaattaaagagaagaaagtcagtttattatgagtagagattaaatataataatgaagaagcaagatgtagattcataaaaaggcattgttacgtagtagaaagaaggcagactttgggattcaaacatttctaggtttgttaccccagttctcgttattgtgggtcagatgaattccttaatccctcagagaaagtttcctttatacaattaaaataatactacctgcctaacacattgtaaggatcgataattaaagcacctagcatctaattagtgttgttaatttcagcactattgctcagcaagtatatttcctgatgtttccttccaaaatgtctattagaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatgtgagtataagggctgagattcctatttctgaacaactgtttttttctatgctacttaacaaaattatgaggaaaataaacagactctaaagtcagaccatctggttagaattccagtcctccacttgtatacagttggatgttttacttgacctctgatacctcattttctacctctgtaatacagggataaatgataactgtctcaggatgttatgagaatctaatgaattaacattaagtgcttagaacagtgcctagcacatagtaaacatttgcttttaaaaaactgtaagaaatggtgtataagaaaagtatttaaatatatcagatttaaataagctcacttacctgagttgaaaaaaatgtatggctaggaagttatcagtgaagttaaatggtggcagatatgtccaaagaatactgcagggatttaatggtgtattaatatggaaagattgccacaatatactggttttttggtttttattttttgttttttttgagacagagtctcactttgtcaccagtggcacaatctcagctcactgcaacctccgcttctggggttcaagcaattctcatgcctcggcctcctgagtagctgagattacaggcgttaatgaatcacatgatgaatgtgtggagatggcggctagtgggcaacagagcaatactggaatagtgctaatatgaggaaatggtatcatctatttagaagcctcggaacgacgatacataatggctatcttcagcaaagaaatttgttgcttacaatatctcctctccaaaaggcttgtttgttacagtgatgtaaaaattaggttctgtacatcttcatattaaacttactttgtgaaaactttttgtttaaaaaaaaaaaaaaaagccataccttgagaagtactgtgctcctgttcccatgccccgactccaccttctctctgtaggtcatcatatttattctttttttttttttttttttgagaccgagtcttgctctgtcaccaggctggagtgcagtggtgtgatctcggcccactgcgatctccgcctcctaggttcaagcgattctcctcatcagcctcctgagtagctgagattacaggtgtgcaccaccatgcctggctaatttttgcatttttagtagagacacaatttcaccatgttggtcaggctggtcttgaactcctgacctcaagtgatctgcctgcctcgcctcccaaagtgctgggattacaggtgtgagccaccgcacctggccttatttctcccgcccccccccccttttttttttcacataaaacatagcatattatattcactgttctatactttgtttttcaaattaacagtatattgggccaggcgtgatgtgactcatgcctgtaatcccagcactttgggaagccaaggcaggcagatcacttgaggtcaggagtttgagaccagcctggccaacacggcaaaaccccgtcactactaaaaatacaaaaaaaattagccgtgtgtcatggcacatgcctataatcccagctacttgggaggctgaggcatgagaatcacttgaacccaggaggcggaggttgcagtgagccaggatcatgccactgcactccagcctgggcgacagagtgagactccgtctcaaaaaaaaaaaaaaaaaaaaaaatcttgtggcaattccatattaatacccagagcttctcaaattgtttttatttgtatgcttttgtttatagctgcatagaattctattgtgtaccaaagtttatttaaccaatctgctttaggcaaatatttgggttatttccaaacctttagcactaaaaacaatgctcaatgaataattacacatggaaacatatacagatgaatctgtggaatacaattctagatatgagattgcagaatcaaaagacaaatgcatttataataatgataaatattgacatattttatagggatttgtcccatttttgcatttctgccagcaacatagaagagcgtcagaacagggcttttctgaatgggttcccactattaacaggagctgtgataatttatacattgacaaaaaaagaacaaaatcagtgtgatatattaaaaacagaatggttttctaatgcaaaagcacaaggcatcagactttatgctatttctaacctttgtgtttatttttatttaacagcatagttgttgcccaaatctcttggtacagaatgtttttgtagaaacacacaacaggaattttccattggtggcattcttcaccaacaggtttgaaattgatttcgcttacttaattctgaaattgtgactttaaaaataacaatagagggctgagtgctgtggctcatacctgtaatcccagcactttgggaggccaaggtggggagactgcttgagctcaggagtttaagaccagccagagccacatggcgaaaccctgtctttactaaaaaaaatagaaaaagttcaccaggtttggtggccagctactcaggaagctggggtaggaggatcacttgagcccaagaggtagagtttgcaccctgtctcaaaaaatgataattataatagaaaaatattttttaaagatatatactatagccccaaatatctggtactgtagaatattcaattatcctaaactgttcctattcaataagattttgcacacctgaaattttgactcttattcccatttagaatgaatgcctgaaagggctgaagatatcaggtatcacccagttccactcgggataaatgatgcagagtgctacataatctttaattcagagctattccccagctacttccacactgcaggcctcaacacatgactgggtcccactgttggcaaaatacacttcttcctcatattgataggttccttcttacttaacattttagtagatttgaaataaaactcaaatggttattcttaataaaaggtcattcctaattggtggatgttgggtgagagaacagatcatatttttgaggatggttaatgttaatatgaaaattgatataatttggttcattggtagttatttagggtattttatgattcttttcaaatttctactttctaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacagaactcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaatatctggatcgataaaacactgtcccatcaaccatttgagtggggagagggagaagctcttctgtaagtaagattctggcaagctctttgaaatgagtcttctttcccacagattttctctactctttctatacaaacagataggagaagagggaatagaaacctggaggaacttgaatatttttgttctagatagagatacagttactgaaaaggaaacctagaaagtagtcacacgttgcttatttaggccagaagtaattgtactgggcaaaaatttcacttaaaaaacacaagaagtccaggtatggtggctcagacctgtaatcccagcactttgagaggccgaggcaggtggattacttgagcctaggggttcaagaccagcttgggcaacatgtcaaaaccctgtctctacaaaaaatacaaaaattagcctggcatgatggcatgtgcccgtagtctcagctactcaggagtgaggtgggaggatcatttgagctcagaaggtcaaggctgcaatgagacataatttcaccatagtacttccagcctgggcaatagagcaagactctctctcaaaaaaaacagcacacacacacacacacgaaaacaattctgaactatgaaatctgaaacagccccttggtatctcctgggcatgatttgcaaatcttttttttttacagaaaaaaggcaaagagtaagcactttgccataggttacttggccgtgatcatctatctagtggaaaaggggactgggaagcccaagcagactgggaaaccagacagctaggaaaaggagcaaaacatagcccagcaacctacagatgaagaaagttgagaaatccatttattcaccatagagacgcaggaatttcaggcaatgcactaaaatgaaatgggggaaaaaagcttgatcagtatgggaaccatttttgtgcaaaagggaatattatggatcagccagtatttctttgagctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtgggatctgtttccagttagatgccattattttccttttccttggtttactcttccacatattggtaaagctcttccaatagcttttggaaaggaaaaatgaaaagtaaatgttttgaatctctgtgtgtttgacaatgtctttattttacccttatacctgattgctgttttggttggcaaggtataggattctttagtggtctccatgcccagttttgaagacatctgctagctttcagtgctgttgctgtggagtctgaaaatctgtcttctggcttccagggtgactactggaaattgaatgccattctgttccttctcttttgcatatataatccatttttatctctcttgaagcttataggtttatctttgtctcaatgttctgtccctgttaagagtccattttcatcctttgtactaggtgcctggtgggatcattccgtctgaaactaatgatttcccatctcttcactgtttctggaattcctgttttccagatgttagacctccagaatttgatctctaattttcctatcttttctcttaactttcagctctgtcttcttgctaggaccttttcctaggagcatttctcaatttaatcttccagttcatctgttgcattttatttttctagtctcatattgtctcatatttttaatttctaagagctccccttctccgaatattctttttttttaatagcatcctattttggctcatggttgcagtattttatctccttgaagatgtttgtgtgtttatgtatgtatatgcacacacgtatacatacacatacaggcatgcatctctgtattctttcggcataatctgtgtcctccagggtttgtttctttgtttcccctgtatgtttgttttggtcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactggatttaggatcggctaattctgcgtccttttaagatatgcttatttaagccaaactcggtatgataatttttttttttttttttttttttttgagagggagtctggctctgtcgcctaggcaggagtgcagtggcgcgatcttggctcactgcaacccccgcctcccgggttcaagcgattctcctgcctcagactcccgagtagctgggattacaggcgcccgccaccaagcccggctaatttttgtatttttagtagagacggggtttcaccatgttgaccaggctggtctcgaactcctgacctcgtgattcgcccacctcggcctcccaaagtcctggaactacaggcgtgagccaccgcgcccacccggccagtatgatagtttttaggaggaaccctcaggagagtgattgtttctcccgctgtgttgtggggggtggagtagggaagcctggcgtttggggtttttttgtttgtttgttttttgtgtgtgtttgtttgtttgtttgttttgagacggagtcccgctctgtagcccaggctggagtgtagtggcgcgatctcggctcactgcaagccccgcctcccgattcaagcgattctcatgcctcagtgtctggagtagctgggattacaggcacccgccaccatgcccagctaatttttgtatttttagtagagacggggtttcaccatgttggttaggctggtgttgaactcctgacctcgtgatccgccctcctcggcctcccaaagtgctgggattacaggcgtgagccactgctcccggcgtttgggttttttaagctattcaaattaagactagactggaatctggagcagtgtgtgtgacaacccctctctgcacacccaactttccccgggccggctagtgactcaaagcgacagcccagatttaagaaaacgaaacctagtgcagctggggcacttccgggatctcgctatccggccgccacccgcagctgcagcacagtcatggcccaggcgtcgccgccccggcccgagagggtgctcggcgccagcagcccggaggcccggcccgcgcaggaggcgctcctccttcccaccggtgtgtaccgcgggggcgggcgggcgggcgggcggggctgggcagcgacgggcccggtcaaggggcctgccttccggtcgtggccgcatgggggcccgacctgcccctactccgggccggggccctagacgccggggcggcgctggacgaacttggctcaccactcgcgtgcctgttggtgggggagggggccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctcacgttcacggaggacgtgactggaacccgtctccccttctccagtcgttccagtcctccccggccctctacttgagtgggtgggtcttctgatgggttcctgcccttgcgtgtgtgtatagctccaaacggtgtgccaggctcagggcaaggtcctgagcatacaaagatgagttaggcagaccctgccctagagactctactaggcaactttaatgaggaggtcagaaccacagaggtacagatgagagactcctgactcccagtcttcagggaaagctttttgaggagaggatggctgggcttaccctttttttttttttttttttttgagaggagtttcactcttgttgcccaggctggagtgcaaaggcgctatctcggcccactgcaacctctgcctcccgggttcaagcgattctcctgcctcagcctcccgagtggatgggattacaggcatgtgccaccacgcccagctaattttgtatttttagtagagagggtttctccatgtttcatgggcttacctttaaagggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtaagtcacgggagatgcgcttccatcctgacctcttcctcaaactccagactggtataaccaacttcttccatttctgaaatgatctcaaactgagtatgtcccaaagagaattcttgtttcctccactgtattcaggtactccaaacctgctcaaccaccagcccattccattcgcccaggtgctccttgcaaaaaccttagtggctcctcagggcctctctttcctccggacaccccttctaatgcatcagtcgggccagccagttctgtgttcagcctgactgtatctggagcctgactgcttctcaccacttccattactgccacccaagcctacgccatcatgatcttctgtctggactattgctttcctggcttctattctagcctttaatacaggcaggcctgcagagcggccaaaatgctttttgaaaaacaaaaagcaaatgtgattctcctactcaaaacccaccaatagtctcccatgactctcagaacaatctatgagcctggcctgcagtttaccccatgtccttatctgatttgactcctgcccatcttaatgactctgctaccctgctaccttgtaggtcctctaagccaccaaagctgtccctgcctcaggatctttccatttgctattctctgcaaggaaaactcattgccacattatcccattttcagttccccatcatattcaggtgtctgctcatatacatcttccctcaaccttgcctgcccatcctgtctaaaagagcaccccttgcccctgctcctgtcactctctacctccttctgctctattctttctctatagtacttatcactacctggaaaacaaaacaaaacttgtttaatgcctgtctctaccactggccactggcatgtaaattcgtcttactctcttctatccttagtgcctagactggttggcctagtagtagtagtaggacatagtaggtactcattaaatattaaataatagtaagtcctcattaaatatttgttgaaggaatgaatgtacttgtatataacactacggagcttgacttctgtaggtgatggggaaatatgagcagatgtccatttcaggtagatcattctgacagtaacatagtacatttccggtagatcattctgacagtaacctagcacatttctggtaaatcattctgacagtaacctagtacatttccggtagatcattctgacagtaacctagtacatttccagtagatcattctgacagtaacctagtacatttcagatagatcattctgactgtaacctagtacatttccgttagatcattctgacagtgacctggtacatttcaggtagatcattctgacagtaacctagtacatttcaggtagatcattctgacagtagcatagtgcatttcaggtagatcattctgacagtaacgtaatacatttcagatagatcattctgacagtaatataaagaatgcagtgggatcatgacagggaaaatagagacaaggacaagagatcactggaatagactaggtgaaagaccctgagggtaaggcagtccaccttccacaccgctgccagcactgtctttctcttaaacacacatgggcacacacacatataaacatgtgagtgcacacacacagatcaagtaagtcatggtccttccagtgttaataagcacgtactggctgcaagtactacaaaaacaatttgatgtaatttaagcatgagggatgcttagtagtagtaagcaggaaaaccagactcacagacccccagagcatggatactttagcatcttacagaaagggctgaggactaggacctgagaagccattataaactttgacaacactctcctttatctcttatttctgcatctctcagtgtatctgctttgttcttctctttctctggtccagttttcctggtgatggtatagaagatggctgcccttgcagcctctcagtttttacatcttctttaagaaaccagcccaatctgaactgaaatcttctatcctgaattctgtatatctgagagatgagcaggtcctctgggactatcagctatgtctagaggaatgaagtacaaacatgcctgctgggggtcattgtgtacgcatcattgtgagctgaacagataccctaaaggagtccattgaatatcctatccttaggctccccatggtccctcctctataacacacacatccttattcctatttatacattctaaagatattcccagtgatgcattctgttcccagtaatgaattctagctataccaaaaccaaattcagtcacacttaacttctgccaaagtcatatctagccacttcatcctgagataatgtgatggaaccattcattctccaaggccattaccaagttccttgccaagcctctaggtaatgtctactgttttggtctgtatccagttcaggtaggcattcactggaccagtgataaaattggcttctacacatccagcaaacagtggaagaactaaaatagtaaattgcaataaacactaatgataaaaggagaagaaaggaggaaatctccaaaccagcaccataaattagttacctaccagtccagaacaaatctatactggaaggggattctaaatgaaatgataggattagtgaatcccattccaactgtttcacccatttctttagtggcagaatgtgttccttgaccacgcttcctggctaccccagattctgtgccctgggtggattacccttggctggagggctttaagagtagaagctagagcctcggcaatccatttccacattgaagagggcctgcagattgccggagagattaagaatcactgtgttgtttgaattagtcatagttcttatattccaggcttgtgatctttctgtggtttcattctgtataaactttcttggctctcagtttcatttgtgagaattctaaaattctgcaatcttgtcgggtcaggctctgtgagtcctcagggttgctaaacccccctagaaaggagcctggaaagccctgctgactattcttggtcccagctactgatgaaaaccaatgggctcttccctaaaatacctcagccttcatgacacacctttaggtatccctccctctctgaatctgtacagttcctgagttcagatggtgagggataccaaactgtccaaatgtatgtggtccatgagtttcggataacacatagcaagagttcagatagtgagagatgcctgtctgtgtaaaagtcctcagtgtgactcccatagtgagagatgcctgtgtaaaagtcctcagtgtgactcctccaactgcagagaattacacacttcctccagtctagaagatcaaaagagctagaagagccgaaatccattaagacactgtgatatggggggatttagcaggaaaaagccactagggagaacctgtgggtcccaccccatgtttttaatccatctgcactgaagacaaactctgggtctagcacagcagtgttgtcagcatatctgtcttgtctgtcttgttcttctctgtattccccgttgtcagagaatacaaaccacctctgtattcccagatgccaagactcttggaacccaagtacttgggagctcagctcaggtatcagtgacttgacagctctgcccagtgcacagaaacaagcaatgttgtacaaaaatgttcagcccttatacaacaagaggcagctgcatatcctgtcagatagtatcgcttttaatttgggagtcaccaacttttgtttttttttttttttggtttttttttttctgaaatggagttttgttctcatcgcctaggctggagtgcaatggtgcgatctcggctcaccgcaacctccacctcccagattcaagcgattctcctgcctcagcctcccgagtagcggggattacaggcatgcaccaccacgcctggctaattttgtatttttagtagagacggggtttctccatgtttgtcaggctgctcttgaactcccgacctcaggtgatccgcctgcctcggcctcccaaagtgctgggattataggtgtgagccactacgcccagccccactggctttttttaagcctgtactttacaagttttaatgtctgttttgagtgtcctttaataagaacacagtattctatcaaagtagattttgggtctgaggtaattagaatattgggatgtttttcccccagtttcatcctagggcaggggactttgtgttgtcaaatattaacatatattctaaaacattgaaaattttaagtgtagcattgttcaatggaataaaacagaagcacaggaggaacagatccaactatatgaaaaggagattttaaattagtggctaaccattatgaatataagttagattcccatctcatacattacaaaacaatttattctatgttcatgaatagtttaattctttttttgtttcattttgttttgtttttttgaggagtttcgcccttgtcgcccaggctagcatgcagtggtgcaatctcagctcactgcaacctcctcctcccaggttcaagtgattctcttgcctcagcctcccgagtagctgggattataggtgtccgccaccatgcccggctaatttttgtaattttagtagagacagggtttcaccatgttggtcaggctggtctcgaactcctgacctcaggtgatccacccgcctcggcctcccaaagtgctgggattacaggtgtgagccaccgcgcccggccaatattttaattctaaaattaaattaaggcaggacatggtgcctcatgcctgtaatcccagcactttgggaggctcaggagggaggatcacttgagcctaggagttcgaaaccatcctggacaacatggcaagatccctcctctacacaaaaatttaaaaattagctagatgtggttgcatgcacctgtaatcccagctactttggaggctgaggtgagaggatcacttgagctggggaggttgaggctgcagtgagccatgatcatgccactgcactccaagcttgggtgacagggcaagaccctgtctcaaaataaataaattgattaattaaaataaattaaaattctagaagaaaacagaggtaagtgttttctatgtccatctcacccaagagcagaaatcataaaataaatgattgttgtaatttcatcaagtaaaacatttaaatattctgtatatcaaagaatattataaacaaagttaaaagaccacatatatgactaacaaagggttaataccctgactgttataaaccaataagaaaataataattcaacagaaaaatgggctaaggacatgagtgccttagagaagaaatgggattgtgaccttactgcatgttacattcgtaagtccagattatgatccacttctctctgcatttcgtgttctttcctttgacttcatcatctaaccttctgtcctaactgtaccttgataatacgtttatttgtttgtttgttttgagacggagtttcactcttgttgcccaggccacagtgcagtggcacattcttggctcactgcaacctctgcctcccaggtccaagggattctcctgcctcagcctcccgagtagctgggataacaggcatgcaccaccacgcctagctaatttttttttttaatgtagtagagatggggtttcaccatgttagccaggatggtctcgatctcctgatcttgtgatccacccacctcggcctcccaaagtgcagggattacaggcgtgagcaccgtgcccgaccaagattgaccttcttaaacaactttgtcatcatgtgcttctcctgctcagacatcctccttggcagcctttcaacacgtttctcaaatcctttcccagcttcctgtgcagcctttcctcctcagcctggctgccttactgtctcagctccgatctctgggccttttcccatatggctgcttccctctacagtgttcctcctagcccataccccaacccaccccacctttccctcctctccaggttgtaccagttccaggcccctgcccttgacaatactccttcccacgaggagcacttcctcggctacctccttagcgtgtattggaattcccactcacttggcagttgcactttgtgacacttaattctgccattttattttcctaactgctatttagtctccctgtttatttcgtaagcttcttgcagacaccagttctatctcaccacatttctttacgtcctctgctctactattcactagaggagcccctcaccacagatagctgttgagcacgtacaatgtgactggtcctattgagacatgctttaagcacagaatacacactggacttcaaagactctgtacaaaagaatgaataacttttatattgactaaatgttgaaaggatgtaagttctttgacatatttggttgcataaagcacattattagcttcacctgtttcttttttgggttttttgtttgtttgtttgtgtcgtttttgagacagagcctcattctgttgcccaggctggagtgcagtggcacaatttcagctcactgcagcctctgcctcctgggtgcaagcaattctcgtgcctcagcctcccaagtagctggaattacaggtgtgtgccaccatactgggctaatttttttgtatttttagtagtgacatgttggccaagctggtcttgaactcctgacctcaggtgatccacccacctcagcctcccgaagttctgggattataggcgtgagccactaggcccagcctcctttttgatttttttaatgaggctcctagaaagttttcagtgatatctgtggctcacatttgtgtcttgttatatgtttcttgttggacagcatcggtctagagtgcacaacatagtgactcaaacacaagaaatgctctcaggctgggtgcagtggctcacacttgtaatctcagcactttgggaggccaagcaggctgatcttgagcctaggagtttgagaccagcctgggcaacataatgggacccctgtctctaaaaaaaaaaataacaaaaattagccagacatggtggcctatatctgtggtcccagctactgaggtgggagactgaggtgggaggatcacttgagccctggaggcagaggttgcagtgagccatcattgcgccactgcactccaacctgagtgacagagcgagactctgtctaaaaaaaaagatactccccagccccccgcccggccagccgccccgtccgggaggtgaggggcgcctctgcctggccgcccctactgggaagtgaggagcccctctgcccggccagccgccccgtccgggagggaggtggggggtcagccccccgcccggccagccgccccgtccgggaggtgagaggcgcctctgcccggccgcccctactaggaagtgaggagcccctctgcccggccaccaccccgtctgggaggtgtacccaacagctcattgagaacgggccaggatgacaatcgcggctttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccccaatctcaagtacccagggacacaaacactgtgagaaacacccaagaatgataaataaaaaataaataaaaaaataataaaaaaataaataaataaaaatgaaaaaaaaaaaaaagatactcccaaatttttggttgttagacatgaatgaaaaaaacagctagctcattccgtctgagcagttttcactctatcttacccttttttcttgcttggtgggaagctggggactgttaatttgtgtccccggtaggtgggacccaaatccaagaaacagaaattaaagaagaaactgatcagaatgtgaaataaacgctagctccaaatgcagccttctgacttggtgaaatgaaagacctaacttaaagagacagagaagagatctggataacagaagagacttagggatcacttaagcagttaacctcatctaaattgaaaacttttcccattaaatggtaaaataaatctttctttcaaaactaaaatttgaaaattataaataaaagctgttttctactacagaaaatcaaaggaagtaagaggatgaacattgcaatgggcaaaaaaatcttaaacgaattcttgtggccaaatagcaaataaccagttcaaaaactttgcctcttactgacacatgggtggagatctcaacagctggctttcttctccctctctctgcctcttgccttttcttcctacctcttcttcccttagatttctttccttttttccattcttcgccttaaaaaaaaaatctacttcctaccttcatgtatctttcctaatcatgatattgaattaaagcacacttaaagtacattgctcatttatgtctttaattctcatagaatttatttttgaatacagtatggcattaggattctaactttttaaatagataattaaccagagcactatttcttaatatgccattgttttcttcttcatttgtagtgacaataatgattattattgagagcttgctatgggcaaagcagtgttttgagaggtttgcctgtatttaaattcctggttgtgtttcttgaataaaggtcttcctcattttggccaggcacagtagctcgtgcctgtaatcccagcactttgaaaatgccaaggcagaaggatcacttgaggccaggagcttgagaacagccttggcaaggtagcaagaccccggtctctaaaaaaaaaaaaaaaaaaattagctggctttggtggcatgcacctatagtcccagtgacttgagaggaccacttgaggttgggagttcaaggctgcagtgagccactgcactccagcctggtcaactgaacaagcctcttgtctctacattttaaaaagaagaagttatcctcattattaggcatttagaagtgaactcattaattcttttcttctattagcatagtaaaaaataaaaaataaatagctttttcacttgggtccccaatattttgtctctctgggaattaagactctctcataaaaacaagtgccctgccttccacttgaagactggaagaggagttagtgagaccaagaaattccacttttccatttctcaccagggatattacttataggtgtctttcaggttgcagaaaagatggaaaaaaggacatgtgcactctgccccaaagatgtcgaatataatgtcctatactttgcacaatcagagaatatagctgctcatgagaattgtttggtaagttacttgaaaacatacttcaaagtacatgagtacttttagtgtaggacacataagaatagataaacaacactttggacacaaagaataacaagttggccatggtttgagcttttaggtgaagattggggagcatttctttttttttttttttttttttttgagacggagtttcactctgtcacccaggctggagtgtggtggcgcaatcttgaatcactgcaagctccgcttcccgggttcacgccattctcctgcctcagcctcccgagtagctgggactacaggtgcccgccaccatgccaggctaattttttttgtatttttagtagagatggggtttcaccgtgttagccaggatgatctcgatctcctgacctcgtgatctgcccacctcggcctcccaaagtgctgggattacaggtgtgagccaccacgcccgggcctggggagcatatttttctgactttgaactgtttcagatttaaaatataacagacactgatagaccttctacccaggtataatttctatcaaagtctacagaattctgagatttatccatgttggtaaacatagctctaagtccttcattttaaatatgatgttcgatttcatgactatattaccattaactgttctgtgaatgggcatttagtttttccagtattgttttctatgactaacaagtcgtcatgaacattcttgtctaggtctccttctcatgtgagaatttccctagtctaggctatacagctaagagcagaattgttaggcacaggaatggggtgttttgtacttgactaaatacaccaaattgttcttcaaagagattgtaccatttaatacacctaacttaccaaacatcatagcttagtctagctcaccttaaacatgttcaggacacttacgttagcccacagttgggcacatcatctaatgcaatgcctgttttataacaaagtcttgaatatctcataaaatttattgaatactgtatagaaagtgaaaaacagaatggtttatgggtactatacaggaggatgtgtgtaggttatatgaaaatgctatgccttttagataagggaactgagcattcacggattttggtagccttgggggttcctggaaccaatcccctgcagacactgagggacgactgcactatggctttattactagccttggcttttattttggcactttgaatttgtggatcagcttttcatgtttgaccaaaataccttttggaattttgattggaattgcattgcatttatagatgaatttgggaaaaaaatagacacattcatatattataatatattataaataattaatataaataattagagagacaaaacctgttaatggatgggaaaaagatgcattcatatattatatgtattaatatattattaatgcagtatgtattaatatattattaatgtgttatgtattaatatattattgtgttatgtattaatatattattaatgtgttatgtattaatatattaattatatattatataaatataaataatatgcattttatataatatattactatattcatatattactatattcatatattcatatataatatattactatattatatattataatatatgaatgtgtcttttttttcccatccattaacagagtctgtctctccaattatttaggtcttttataaatttcaaaactgttaaataatttttatctgtagtcatatagaacttggggttgggcatattcctgggcaagttttttgttttgttttgttttgttacttttttctaaaagctttttaaatgaactattatcagtatatataaacactatttatttttatttattgatctcatccagcaaccttaccaaagtcttattagttctaaaacttctctagatttacctggatatattgtatgtggacaatcctcatctttaaataagaacaattttatttacttacctttaattcgggggactcttaatctctttttcttgtgtttttccagaacattcaattatagcggtgattacaagcaattaaatttggaagccctgtcttgcttctgatattaatgggatgctccaaaaatcttatcattaaatttgtgtatgttttacattcttaatgatttcatttaattaaaataaggaagttacctttatctctaatttgctaaaaattatagcgtattgaatattactaaatgcttgttctgcatctattgaaatgatccgggttctttttctctctctggccacaaacagtgctaaatgctttattttatttcacttttttatatacataatttgatgtttattttaaattacaaatttatggaaaagttgcatatacagtacaaagaactttttttggtcagaaccattttaaattaaatgatatgcaatctatcctgaatactttagtatgatttttttttttttttgagacagagtcttgctctgtcgccccaggctggagtgcaatggtgtgatcttggctcactgcaacctccacttcccaggttcaagcgattctcctgcctcagcctcccaagtagctgggattacaggcacatgccaccacgcccagctaattttttgtatttgtggtagagatggggtttcacgtgttagccaagatggtcttgatctcttgacctcgtgatccacccacctcagcctcccaaagttctgggattacaggcatgagtcactgtgcccagcctttagtatgtattttctacaaataaggtgatatgctttggctgtgtccccacccaaatctcaccttgaattgtaataatccccacgtgtcaagggtggagccaggtggagataagtgaatcatgggagcaggtttttcccaggccattcacatgatagtgatagtgaataaatctcatgaaatctgatggttttataaagaggagttccccaaaaatctctcttgcctgctgccatgtaaaacatgactttgctcccccttaccttcttccgtgattgtgaggcctctccagccatgtggaattgtgagtccattaaacctctttttctttataaattacccagtcttgcgtatgtctttattagcagtgtgagaactgactaatacacaaggacattctctctcacactataacaatataaacgtcaaaatcaggaaattttgttatactactaccgtctattcctcaaaccactgaggtttcacctgttgtactaataacgtgtgtgtgtgtgtgtgtgctttttttttgagacaaggtctcactctgttgcccagggctagagtgcagtggcaccatcatgcctcactgcaactttgacctcctgggctcaagtgattctcccatctcagcctccagagtagctgggactataggcatgtgccactgtgcccagctaatgttttgtactttttgtagagatggggttttgccatgttgcccaggttggtatccaacccctgggctcaagcaatcctcccacctcagcctcccaaatgctggaattacaggtgtgagccaccatacctggcctaataacattttttataacaaaagattttagctcatgggttgcatttggttatcatgtcttaagttttttcattttattctgttagtaatgtgtgttttacttatatattttttctgctgtgaaaccattcttagattaacaccatttaatggtgatgttttatttttacttatttatttgagacaaggtctccccaggctggaatggagtggcataatcatagctcactgcagccttgaactcctgggcttaagcaattctcccacctcagcttggactacaagcacgtaccaccatacccagctaattttttatttatctttttgtagaaatgggggtcccactatgttgctcaggctcatctcgaactcctggcctcaagtgattctcctgtctcagcctcccaaagtgttgggattagaggcgtgagctaccgctcccagcccaatcgtgatgtttttattctaatatactgttgatgttgatttgctactattttttagttaactttattggcataatttacataaaatcaaatgtacccattttaagtgtccaattcagaaagttttgagacatgttgagacccatgcaaccactaccaccatcaagatataaacatttccattaccccaaagggtttcctcaatgttctgtgcaatcaattccttcctaccccaagtccctgtagatttgtcttatcttttctcagatttcatatgaaaggaatcctatagttgtcctcctttgtgtcacttcctttgctcagcatactgttttagatgcatctatgttgcatgtatctgtatcttgttcctttatcattcttcacagtacttaattggtatgcatgtatcacaatttgcttattcattcatctgttggtagacatgtgttatttccagtttggagctcttatgataaaaatcagctataagcatctgtatatgagtctttgtgtctttatttaggcctttcataatttcaaaattgttcaatggcttttttttttttttttgagacggagtttcgctttttttgcccaggctggagtgtgatggcgcgatctcggctcactgcaccctccgcctcacaggttcaagcagttctcctgcctcagcctcgcgagtagctgggattacaggcacctgccaccatgcccagctaattttttgtatttttagtagggatggggtttcaccatgttggcctgactggtctcgatctcctgacctcaggtgatccacctgccttggtctcccaaagtgttgggattacaggcgtgagccaccgcacccggctattcagtaatttttatctgtagaggtatagaacttggggttaggcatattctgggcttgttttttgttttgttttgttacttttttctaaagtatttttaaatgagctattatcagtatatatgaacactattgatttttatttattggtctcatccagcaaccttaccaaactcttatcagttctaaaaagtctctagatttacctggatatattgtatgtggacaatcctcatctttaaataaggacaattttaatttggggcactcagtctccttttcttgtttggttatgtttgtcttgggtaaatagctagaagtagaattactgagtcataaagttagtgtatgtttaaccttaaaagtgattgcattattttacatttctaccaataatatgtaagaatttcatttgctccacatcctcatcaacactgggtcttgttattttaggcagtctagtagatatatattgcatctcactatggctttaatatgcctaagggttaatgatattgagcatcttctcatgtgctcatttgccattcataaaccttctttcatgaagtgtctattcaaattttgtgcccacttttaattgaattgtcttattattgagttgtaagtgttttctaaaatctggatacaagtcttttgtcagagatatgtattgtgaatattttctcccagtctctggcttgcctctttgttttcttagcaatgtctttcaaagacaatttttattttgatggaatccaacttactttttctttatgctttctgatttttataagaaatcttcgcctatgccaatgtcaccaaaatttactcttatgtttctcatgcccttttgttatttgagtgtaatatgtgaaacattgatcttcaattcagatttggagtcttctggtttcaagtagcacatagagacttgagccagcctaaacataaaagagggtttatgataaggttttgggggcatttcatgtttcctaaaggcaggcatgcaggtgggtgtaagaaacagctagaaagccattgggaacctagaatgtcctctttctagcccttgtttttctttctttgcagactgacttgctctaaccacgtggcttcagctattgctcaaagcccattccacacttttaggataggggatcagactgacccagcttggcatcagggttccacccaggtcaatgagttattagaggtcaggattacaaagtataaaacatgcccggaaaccagggtcattcccagagaaatgggatggcttatggtctgctcatccacccccaaagttgccactgttttacccccagtccatttcccactcctggtttgattttccacttttggtatgattttctgacatgtagctttcaatattactttgtgcatactctggatttttttttccaatctgcagctgtattcttcaggacttgtggaatgtgaggatcaggatccacttaatcctgatagaagttttgatgtggaatcagtaaagaaagaaatccagagaggaaggaagttggtaagtgtaaatgatgttatttcttatactggatgaacagaccctcaaggaatgcattccaaaggagtctatttgactgatacaccagggatagagaagcatcttggagagctggaagaagtaggaactgtattggaaacctcaattcaacttaacatttaatttttttttttttttttttgagacggagttttgctcttgttgcccaggctagagtgcagtgacacggtctcagctcactgcaacctccgcctcctgggttcaagcgattctcctgcctcagcctcccgagtagctaggattacaggcacgggccaccatgctcggcaaatttttgtatttttagtagagacagggtttcaccatgttggccaggctggtcgcgaactcctgacctcaggtgatctgcctgccttggcttcccaaagtgctgggattacaggtgtgagccaccacgcccggccaacatttaatattttaaaataaactaccatatacttcaccagtaaagtgatctgagttagaatgcttttgctgtaagtagaagaaagctcaagtcaaacagacttttacaaagaggatacttactttttcacttgatcagagaaaacacctgctttccaagttggttgattgagtggcttgataatgtcatcaggggcccaggttcttcctctctggcctcctgtccccaacatcagctggtcccattgtggtcatagggtggccgcaggcagcaactgaagcatcaggctttcttgttcatacccagtgaaagacaaaggtcatccatacacatggaataagcccccttctgaaagtttcattaggttgcacccctctttctgcaccaactgctgggggtggccataactaatcaggggtcagctcctcatgggtcataagggggctattcaaggaggaagaaatgctgagaagtcattccactgggcttattgcagcgacatcctctcaaggacccttcacatcttagcaagcaggacagcaagtgtgagcacctcacattctgactacaaccacagggttaataaccagggacaaatgtatagttagtctttgcaaggcatcagcatcagcagcatcctgtggtaggtgtgttacatacattgctctaggtaaactcccagctataggtaaaatgatgcccattttaatcgaagaaatggaaagtgcagggtgaaaggcaacagtccagatggaattctgcaaattatgctatcttaggcagtgtacacaatactgtagtaggtcctgaagcaagccataaaaatggactgtgtgtggcccgggcatggtgctgcatgcctctaatcccagcactttgggaagccaaggcagttgaggactgcttgagcccaggaatttgagaccaacctgggcaatatagtgggaccctgtctttaccaaaaaagaaaaaaaaattagcccgacacagtggcatatacctgtagtcccagctacttgggaggctgaggtaggaggattgggtgagcctggaaagtcgaggctgcagtgagctgtgatcacaccactgtactccagcctgggcaacagagtgagactctgtctcaaattaaaaaaaaaaaaaaagagtgtgtggatcctgctctcaatgtctatgctattactaattaatacttggcaagactggctgctgacatcattagtgctgacaatgccacatccctaggattttgggtgtgatgagatgggtgaactgattagaaagtagcagacagacctcaactggaatatttttttgctcttcactaattggatttgagtggggagacacagagttaaagaaatctctgtgaaattctagtagccatccagttatgaagagacccaggctgagaaatgagggcagttgattggaggcataatatttgggggaaagcaggtacctgagggtttctgcggaccttgggatgcagacttccctactgggaaggctttgggatgggttggaagtggaggataaaggagagaagagaggaaagtcacctgaggtaatagttaccctctcacagcatttatggaactcttggactatgtgggcagatacatggcacacacccagggtggggacaggccagtgctgtggtattttcagtaagctgggcaagtaccttgagggtgagcagcaggggccctcagcaagcaggctcctccctaggattcagactaccaatctgacagagccacatggacatccaatagcatttcagagtaaagtggccaaaaaagtacagttccatctcctatacacacacacacacacacacacacacacacacacacacacacacacacattctccatctaaatctgctcataaaaacagcactatcattatccatttgcccaagccagaagtctaaggactctcttttcctcgtcaacctcccagcccaacaccaagcccatgggcacgaactcctaggtgcatcttgcattcatccacccacttctctcagcgtcagtaatccaccatagcggagtcacccatcttgttctctaaagcgagtactgacactcgcccgactgtctctcctgccatccctaccccagcccgtagttctccacccagcagcagcccagcagcctgagtgatctttcaataatgttaatcagtttatgttccccgtgcagaaagataaaacccaactccttactctggcatgtaagtcctacgtgacccagcccttacttacccctttgatcatcctgagacttccctgtgcccacttcgctgctccaacagcactggccatctgtcttgtcctcgctgtagcttgccaatggggaagctcattcttgcggccaagacccaaggccctctgcttagaatgtctttcctcctcctttttgcatctgggagctcttactattattcagatctcagcttccatatcacctccttagaggtgacccattttactaactgcccagtctgaagtagggacccagtgacactgtcacttcaccctattttaattcgatataatgtgtatataactttgtgagacgttttaaactttgctttatttgatcattgtaccttgtctccaatagaatgtaagcttcacgtggacaggcatcttttctgctttgtccactactgttttcccttatcctaaaaccatgcctgccacatcatagctactgcatgctaaataaatactatatactcatgtatttttaaatgaataaatgtttattagccatttgtattttttcttctgtaatttgccagttaccatttttctgcaggttatcagaatcttaaaactttatctagtatgctacaaacattcttctttcaatcttttccttgtcttttaaatattttgaatgccctcactataaaatggaagtttaaaatttttgtatagtaggttctgtcagtttttgtttttgaaacagattctccgtctgtcgcccaggctggagtgcaatcacagctcaccgcagccttgatttcctggccccaagccatcttctggcttcagcctcccaaatagctgggactacaggagtgtgccactatgccccgctgatttttaaagttttttgtagagatgaggtctcactgtgttgctcaagctggtctcgaactcctgggctcaagcaatcctcctgcctcagcctcccaaagtactaggattacaggcatgggccaccatgcccagcctgtcagagttttcatttgtggcttctgggttttcttcctgccttagacagccttccttgcctccatactacgctttttttctttctcctatatttcctaatctttaagagttttttgtttaacattgttatctggttcgagctttaatccatgtacaacttattcaggagtatattgtgaggtagggatctaactttatttttttcctatatacatagccagttaccctcctcccaaattaaatgatcgttcttgtatgctctgatttgaatttccaccgttatcataaccttatttcttgcctatatttgaatttcctttaactgtttctatgcttgcttgtgccgaccctgggctatggtgtgagtgacctcctgttctgcaaggcaatttcactgtgcccccacgtcattcagccagagtatcatgctgatcagccttggtcctggctggattcccctaaaccagttaggctgctgtggccacacactgcctagccatcatgacaccactgtcacatataaaataccagatagataaatacaagccagggatcaaataaattgaaccaagaaaaaactgttaatagagttgtagaatttttaaaaatttttggccctactacctagattcccttactttatctcacattatcctcaatggcaactctgtaagacagatattatcacccacagcaggttctgagtccgaaagagaaatcacaccactctccgtggcacagccagcgaccaatctcgcctgtctcaaagggccccctagtggggccccttgcctggagctggacaagtttgcccactctgctttttagaaaattctttttaaaagacagagactgtttttttgaaacaaaaagcatttttctgcttttaatcagatcattacaaaactgtctgtccaagcattccggttagctgaggtttcgctgaaattcccaaatgagcagccaaatataagtactgtaccctaatgtttgtaacgggatggaatcttgctgatgatgcccaggataaaatgcagggcttctggaacttaaataacatttaatgatatctttgaattttaacaaataacaacaaacaggtacttactcagtaaaatctattcttctgtagaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataaggaatggttggattaagacaaggagactttgaagactaattttatgtaaatggttttcaaatgagaacaaagccagtttgggggatgcacaggggttatgtgaattttgaatttcagtgaaaaatctatatatatatatatattattttagtcacaatatcttgaataatgagatcaatgttaggacagcatgtttttttaaatatgatttttgtgagctatgttacattcgtaagatgatttttaaaaattccattcagaggctgatgtttttcctgccagtgggcatatattcctaattttcccatagtgttccaggcactattttatttatttatttaataaccacttgctttatgccaggcatagttctaagtgctttacaaatgttaactcatttaatcctcataatagtcaactgaggtagatactattatctccattttccagaggaggaaactggggccttgagacactcagtgacttgtccccaggttacacagctggtcagtggcagagctgggctgcaggacttccaagtcctcgctctttgccaccttgttgtcttcaggtatggggactatatattctaaaacaagagggcaagcctaccattgaaagaagcttgctaaataatttttttttttttttttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcaatctcctgacctcgtgatccgcccgcctcggcctcccaaagtgctgggattacaggcgtgagccaccgcgcccgggctaaataattttaaatctgatttcgagcaagttccgtaagtattttgttgctaatcagacatgaaatgtgtaaatatgtaaatttcgtactgcacttctttttatatttgattcactaagaaactcacaggttgttatagtctcagagtttcatttttattatttaccttaccaaagagctcgttttagtatgacctttacaatgaccttaaacacaagatcaaatgaaaaggaatgtccctgctatagcttaaagtttgaaaaaatatactgatcacacccattagaagaactaacaaatagggactcaataaaacagtcttcttgcattgttttatcaaggaacaggtgaatttttacgcatttttaaactgaatttaaaccttcatgcctatcatacatgaggcaccttgctaggtgctacgagatacaaagaataaaatatagattgaacctcagagaagttatcacctggtgggaaggccagaagaagggtcaatgcaaacagaagcacatgggataacgagagcaggaggggttacatgaaaggagcttggccttgagaattgttgacactgtggaatggatggggacatgggggttcatcctgatattttcaacactgttttatatgtttgaaaaaatttaagtacttgggaagtgaaagtgctcagagataccagaatcaaagtgggatgagattaactttgtttgggtgttgctgggaagactgcatggaggaggtgggaactggtataagatgggaagaaacggtattcccctaggcaaggaggccactgcttcctgagagtcagcgccatctgaagaggaagggagatgaagctgggtgccgaggaggaggaaaggttagaaagtggcctgagcagctctataaaacgattcacttcatttcttttgttttgttttgttttaagacagagtcttgctctgtggcccaggctggactgcaatggtgcgatctcagctcactgcaacttccagcctcctgggttcaagcgattctcctgcctcagcctcctgagtagctgggtctacaggcacgtgccaccatgcccagctaatttttgtatttttagtagaggcggggtttcaccatgttggccaggagggtctccatctcttgacctcgtgatctgcccgcctcggcctcccaaaatgctgggattacaggcatgagccaccgtgcccggcctcacttcatttcttcatcatagcctgctatgctgctgctttctcttggaagatactaatcagttctaggccctttgtaggtcaaatctaagatctggggcaaatacctgttttcatcgaaaatgactttttccttaaattaatgcttgcaattttgtgctatttattgttgaaaaccagcagaatcttgtacagtcagatggaaatctgcatgtcttagattgtggatctttaggtatctttatacagtaaaatctcactgaccactgtatatgaactagtattgttcataatacttcatcagtactcattccttgaaagaacataatcatcttcctaagtccctgagggcataaaagacatctaactgagtctccatctgcactcagtgtgggtcactaattttacacagggcttcaaaaaaaaaaactttagtgtgacgccgtcatgaaaagtaggttggtacgtttttaatcacaaaaatagacataatatttgaaacctgtaaataaaaatattttacaattctttgaaattaaatatttcagactgctttgccagcaacatgctcaattcccgatcatcgctcaaagtggtaagtttctaaaatttagcactgtgggttttaaagaaaggtaaacatttatgtaacataaggaatagtctaattttctagcctcgttgaattaaaatacaaatgtttgagttaaaattttacacatctagaaaattgacaacttctttgtgtactatgtgatatgactgactaattttttcttctttatgaacaagacctattctctttgaaccattccctggtatctttcattctccctacgctcacagaaccaaactaagacatgggaaaaagccttgacttttgggactgcttctcttccataagaattttcagtagataaaattttaaaagtgctgcaccttccctgagtgaaaattccctaaggatgcatggttagcatttcagttctaattaaggcagactggatcctggctaactggagtcatggggtatactttcattcatgagtggaacagcagtgtcttagcagcactacatctgcaatgttcattgtgaagtggagtcaggacctcgttggaagacttcgttctgcgtcatgccaactgcattttatggtgataacattctccaaatagcacctctacaatcatttttcagtcgttacccttttaactcagcaggaaaggctattacagatacttctttaaatcagtgtttattgacagggaaaagcaccagcaatacacacttaaccaaatccttgcaaatgtcatctattaaatatcttcatccttattagtctgttttactttgaatatcttctgagtgaaattgagtgcattcccatatcttttcaccaattatatttgttttcctatgacccaatttgttcatttttctattcaatgaaccctctccccagagagttccccatgtgccaatttttctactcaattatttacctgttttgcattaaacttataatatcttttttaaaaattaaccctttatcataagtgctgcaaacacttagttgaagtttgccatatcttttgactttgtaaaaacttttggcatatgagttgtatatttcatgtagtcaaacagtaatcttttcctttatggattccaatttttaaatggtttatatttttagctaaattttcaggagtgaaaagaaaaagaggaaggaagaaacccctctcaggcaatcatgtacaggtaatttgacttagtttttatagctttgcatttcttcatacagagtccttatttaaaccagtctgaatgtcaggtgaaaggtactttccaaatcgtccaaacagagagcctttgaagaacattcttcatttgtgttctcagctaaggctgctcctgaggttgcctttttaggaagaatcccatagtcgggaagctcttagataattcctagatgatagaatcatgatgagatgagcatgaaaatgaagctggaagttccaagcacataaccttcaggaggtgacattctccgagctcctataaattccctggcaccaaactagtgagagcatctgaccccacaggtgcttacagttaaaacgggcagagggtgcagtcaaacatccttatggagccaagtatttcccagctgcatgacccacacctgaccaaatctgtagctcttataaatttctggattatgtataaaatgtatgaaaatattttggggatttgagtttttacacatcagcacatataagctaaattcatatgcgccagcaaccttcacctcctcctgtttatacaaggggtgcttgtcaaacacctcttaatgttttataatacaaaacaaaaatatatttgatgtttacatctaaatatgaatatggggtttttttgtttttttttttttttgagacagagtctctctctgtcacccaggatggagtgcaatggtgtgatctaagctcactgcaacctctgcctcctggattcaagtgattctcctgccccagcctcctgagtagctgggattacaggcatgcaccaccacgcctggctaatttttgtatttttagtagcaacaaggtttcaccctgttgtccaggctggtctcgaactcctgaccttgtgatctgcccatcttgccctcccaaagtgctgagattacaggcgtgagacaccgcgcccagccagggcatgatttttactgtaggcatatcatttagttatgcacagcaaaagactggttttcattttatgcaatattaaaatcaatgtaatgcaatcttgattttctctcctagccacccgaaacaatgaaatgtaatacattcataagacaagtgaaagaagagcatggcagacacacaggtttgcgctaagtgttgtctgtaacaaatatggcctacaatacttataaaaatgtcaacccacctgtttcaaacttggtatcccgcctaaatctttattcttctaggcttgtggtaattaatgagtataaatctttatcgcaactgtccactctattgtaatcccagcatatcaagataacttaggttggaatggtccattgcattcagtattaagaaaagatagacttctattaataaagacacagacaggcttgcctgagctcagaatccagcaatgtgtcacccctcacactgtgacccctgtaactgtagttctctgttctttaaagaaatagacattccactaacaacacatacaaactgtgacaagaagtgacaggggctgttatgtcaaagacttaagggtaatttttaaaaatcctcttaattcaactacatatcgggtacagtgtacactgctcaggtgacaggtgcaccaacatctcagaaatcaccactgaagaacttatccatgtaacctgaaaccacctgttccccaaaaggtattgaaatttaaaaagttacagttttatatgtttaaaaaagcctcttaattcatatagttattgtaagcagagaaattttcatttttactttttgtaacattttattcattgtttcagctggccaaaaaaaatgaggtatgatgaaattataattaataaaaagggtgaaggtgctgtattattttactaagtatgtgcatccaccactaggcaaggtctgaagaaataagcataaagtaatttatgattagctgccctaagactatttccttctcaaatgtttgtcttattcttagatgcaactgtgaaagttccttttcttaagaaatgcaaggaagcaggacttcttaattacttacttgaagaaatattagacaaagttcattcaattccagaaaaactcatggatgagactacttcagaatcaggtactgatgaagagcaatatttcgaagtatagagacttctcccagatctagatttaaaacaaaacaaacccaagaaaaaaaaaaaggcccattttcttcctatactacttttttcttctatcagcttttggaaatgcttactatttatttcactttttggttttgccctatagaaaataatcccattcaaataaacattttttatattgttgcctacaatataagctgtccagcttgtcattctttacctttacctcattcttttttttttttttaagacggagtttcgcccttgttgcccaggctagagtgcagtggtgcgatcttgcctcactgcagcctctgcctcccaagttcaagcgattttcctgtctcagcctcctgagtagctgggatttcaggcacacgccactacgcctggctaattttctgtatttttagtagagacaaggtttcaccatgttggccaggctggtcttgaactcctgacctcaggtgatccgtccacctcggcctcccaaagtgcttggattacaggcatgagccaccatgcctggccctttacctcattctttaataaaataattggaccagatctactatccttcataaatcaacaggatgtgggtaatttacaaactcagtaatttagtcaaaagtaacctcatgccctgagagttgtggtacattttccagaggtgtctaacaggttggccactaagagaatgtgccattcagagattgattcggtcacatatgctcccctgccaccgccctgcattcctgttgctaagatctgagaacagtgttatgttacagttttgattttggaatccaattctattccttaataagccaagtgtccttttttaaataaggttaactcaaactttaaagtatagaagaaggaattttaatgttttgactgatgtttggtttaaagatgtactttgttaaagaagtttctttcttaagggctctttgggaagtcaaagttccatttgtatgtgcaggtatatagctacttagctttttgtttgtttgtttttgaggcagagtctcgctctctctcccaggctgaagtgcagtggcatgatctcagctcattgcaacctctgcctccagggtttaagtgattctcttgccttagtctccagagtagctaagattacagacatgtgccaacacactcggctaatttttgtatttttagtagagatggagtttcaccatgttggccaggctggtcttgaactcctgatctcatgtgatctgcccgccttggcctcccaaagtgcggggattacaggtgtgagtcactgtgcccagccttacttagctttcttataacttatatcccatgagtttaaaacctttattataaatatagttattttacaaggacaagctggacagcttatattgtaggcaacaatataaaaaatgtttatttgaatgggattattttctatagggcaaaaccaaaaagtgaaataaatagtaagcatttccaaaagctcatttattatactattttattcatttatttcctctagaccaagcacttcccaaacagtgtgcctgagaaccacctgtagggctggtgaggacacagatagctgggcctatcccacagagattctgattcagtacaaataccaagaattgggggccaggcgcggtggctcacgcctgtaatcccagcactttgggagcccgaggtgagtggatcatctgtggtcagcagttcgagaccagcctggccaacatggcaaaaccctgtctctactaaaaatacaaaaattagccgggcgtggcggtgcgcgcctgcaatcccaactacttgggaggctgagacatgagaatcgcttgaacccaggaggcagaggttgcagtgagccaagatcgcaccactgcactccagtctgggcaacagggtgagattctgtctcaaaaaaaaaaaaaaaaaaaaaagaaaaaagagaaatgccaagaattacatttctgacagcttccctgtagtgctgctgctgctgttgccatctaacattaaagttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttcctgcggcttctctgctcttgggtggcgaggctatgataaaccatccctccgcttgcctccctctcgcttggtgagataggtcaaaattttaattctcccactattaatcctcaaatctaatttaatttcttatcagggagggttacgactgatttaaagttcatcagaaaaaaaaaaaacaaaaacaaacaaacaaaaaatgagcaagtaagaatagccaagaaatgtttgcagtagaaaatctcgtttggtttggaggagggagatttaaccttcctattaaatatcaaccatttattgagtgagtcctcctttcagcattaagatgccctcaagacaggctacacctccacttgtttatgagtctggtctgacttctctatcaaggctgccacacacagctgggcaggccgggcacagagtcaaacagcattggtggatggctccccctgaagttgcacaacagagtgagtgccctccacactctgcatttccacagatgcatctgtctctccagcatatggtaggaagacaataagatttccctgtgaagaaatcattagttcatatccctgtctcaacatacacaacctttctcattttggcttctatattatacatttctatttgaattttttactacatttataaccagcaggaaaaatactttgaaaaatctaccaaaaagagtgtctgtcttaatagtcttttgaggatgtctgctaatatatagcagtatccatatttttttaaagcagccttaaaaatttttttctaaaaagagttattttgtaggggacttccatgtgtgtttttctttcatgtaagggaacatgtcacacatcactacttggatggattaggtgggagtacatatattatagtgtagtatggcgggggtgccactacttagaactgcatgagattcaacttaaaaggcttaagttgggtttcactaccctggttgataaaaacttgcttaatttagccttactcatattttaagttaactatacgtatgcagttattctgaataaagtttgtatatgtgtgtaactgttcgattttgaggcttttaaaaattacattgccattgactactatttgttatttataaagcctaagtatcttcctcctaagcttttctaagtttccacaattaaaagccttcctatttctaaatgaaaccaaaagcctttatgtaacattaaaaattggacacatttttaggaaggatttgtccttaaccttggtattctagccacattctccaattatcatctctcaataaatggatatagtatagcatgaaggttatacagtcactgttttcaagttctcaaagatatacaaagggacttgttctgctataaatgtgcacaaaatcttaagggtttactgaacagctttgtgtatgataaatgttagaattctgtcctgaattagaaggaggaagtgaaggcataaagaaaccagctcctgcccataaggctctggatccttttcaccagaggcacgaggattgtgtatctgtacctgcaagtgaaaggggctagaaatggtacattatttctaataaaactactgaataagctgaaataattttatttcttcttttcatagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccgtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactactttacttgtaccaaatttgcctgttttcgtgtcacaaagtctgcttttgaaaagtctcttttcagccacagttatcacgtggagattcatcatcttcaaaacagacacctaaattttaaattggactctgaataagaacattatcgggagtatgcaagaatgaaaaaaaaaattgacagttacatttttctcaatctaatatacgattctggtttttatgcccacactatcacgtctgacccctgaaaacttaacattcacagttctcattttttaccatggtactctgattttcaataatgctgcgtctcaaaatgggttttaactgagtctccaagcatggtgtctgacatgtaataaataagtactggaaaaatatttgcaggagatgaaaaagaacagtccattccagttgtaatggcagccctagcctaagttcttatatcttagggacaaaatctaaaccagtggatttcaaatccggccgcacatcagaatcatgtggggcactttaaaaactacagaagtgaagaccccatccaacaccctctgaacagatttccgctagtctagatgattattgattactgtagcttcagcttcctatcctgatattaagtcttagcaaagtttttggttgttgttttgttttgtttaagacggagtctcactttgttgccaggctggagtgcagtggtgtgatctcggctcactgcaacctctgcctcctaggttcaagcgattctcctgcctcagcctcccaagtagctgggactacaggcgcgcaccaccatgcccagctaatttttgtatttttagtagagatggggtttcaccatgttggccaggatggtctcgatctcttgacctcgtgatctgcctgcctcggcctcccaaagtgctgggattacaggcgtgagccaccacgcccagccatcttagcaaagtttatctgactaatcattctgatgtcatgatctttatttaaaaaaaaaaacctttgtcccccactttactttcacgtttaacctgtgactcacacagcatgtaactgtgcaccatggagcaccatgtgtttggtggccatgaggctggctactgggcaaacccgagtatgggttcataaggcggagccgagtatgaacttcagctatgtcactactgaaaaacttgaatccgattatttaatctgagaatgctgctgcctaccttatgggacaaaatatggacaagtaagtaaaatgtgaagcagagagcacaatgtctggcactatgggaaataaatgttaaaacacacccatgcacgcacacactccccttgctaacatttctgtcttattttctccattctaaccaaacttaattatgataagctctggaaggctcattagcccccatctcttgtgcctctttttgttttggagatgagctaaaaggacactttatattttcccctatccaacacaagcgttatcttcagaacaactaactgcttgtcatgttaaccctattaactgtattagtccgttctcacactggtatgaagaaataccagagactgggtaatttataaaggaaacaggtttaatggactcagttccgcatggctggggaggtctcaagaaacttacaattgtggcggaaagggaagaggcccgtcttacgtagtggcaagtaagtgagagcacgcaaagcccagggggaactgccatttataaaaccatcagatctcataagaactccctcaatagcatgagaacagcatggggaaaccgcccccataatccaatcacctcccaacaggtctccctcaacaactgaggattacaattcaagataagttgggtggggacacagagccaaaccacatcatcctatttggttttctctcactgactgttatgaaaagctctttataagtatctcattgtgttgttaattcctaaacctatctccctctctcctaataattcatatgttctttgaggatagggaatatgcctttcccttcaagtacccccaaaggtacagacacatttttctactgtgccagttcaactgtactacccttcagcaggaataaaatccaaagatttctatgatgtttgtttgtgtatagttgagaatcaagcagttgacatgttcatgctggtacctatttttagcctgatacccattaagaatcacaccactgattttttttattatggtaaaatatatatataacctaaaatttgccatcccaatcatttttaaatgtatggttcaatggcattaaacattcatttttgtgcaaccatcaccaccatgcacctaaagcagcagtccccaacctttttggcaccagggactggtttcgtggaagacaatttttccacggaccatggggatggggcggttggtcaggggtggggaggatggttttgggatgaaattggtccacctcagatcaccagtcattagattctcatatggagcacacaacctagatcccttgcatactcagttcactgtagggtttgcactcctatgagaatctaatgttctaatgttgccactgatctgacaggaggcagaactcaggcagtaatgctcactcatccgccactcacctcccgctgtgcgacctcttcctaacacgccagggatgaatatgggtctgtggcccgagggttggggacccctgacctaaaggactcttcatcttggaaaactgaaactctgtatccattaaacaagttccccattctcctctcccctcagaccctggcaatgaccattctactatgtctcaatgaatttgactaagtatatcacacaaatggcatcacatagtatttttctgtgagtggcttatttcacccagcataatatcctcaagttcacctctgtgcaccatgtgtcagaatttctttcctttttaaggctgcagactactgattttgaaggaaaaaaacaactctatgtgcctgttttaatgttactttgtttattaacatgtcgttctaaatattacataaatacagcttacatactagagtatcaaacattgttccagtaagaagttcaagagtacatttagggctatcttaagaaatatgaatactttggcttccattattacattagatgaaaaaatcaattcaaataagagttgtcatatcctgctatgattaacaaaaaaacaagtagaaaaataagagagtgtatttaaaaaaaataatcaaatgctttttgaaagacctgttctcttcactgccacacatattcatacaaatgacttagtaatctaatatgagaagtggtccttcacttatattaggaacttggtaaatatttgttgaatgaatgaactatctatggatatgaatttactactttaatttgtgctttttttgaaaaaaagttttcaagtaagagcaatagtaaacatactgaagttcacattttgctcagatcataagcctatagaacagtgattgttacaaacaccacccatcatagcacaaatcaatgtgcatttctgaagctagtaagaaaagttctatcatgttgtagaacgaattctaaccgactaattcactgggcttcaatcacttgtgatatggtcaagaaaagggggctggggctcctaggcttgtatctatttcagctatcagtgaattcctatctttagggcctcactccccttcccaccccaatagacacaaatttaaaaacattgctaaaaatagtagttgtagcatgtcttcacccacttgtaatttggctctgaaaatgtattcaggctccaggttcagaagagagactttccaagcaggagacaaaattcactaagggaactcactcaaatggaaatgagttcatggaccagagagcaaagcaaaacattgctcttaaaagcaagctcaacggacacacatgatgaaactcacagttgaacactcttacatcccaaagtcaccttccataaccagttcaaataaactactgtcttttaataggatcttttcaggaacaccataattttggtgctttttcaaggtgaaattgtgctgttatacctaagatgtttaaaaacagaggaaaaccaaaagtgaaagatgataaagtttcacataagccaatgtgtgatggatttggcctaaagtagataaagcaaattccactaagtcttgtaagagggttgacttgaagaaccacttcttccagtcatatatagtagatatgatgattcagcagtcataatttaggaaggcaagagtatactatacatgtcattattttcctcttaagtttgcatttatagaagaaggtggtgggggacaatttaaacttgagttctcaagttctaccttaatgaaataaaacaccattggataagtagtggagattctaatttataaaatattcaccttcatcaaatttctttcattatcaacttttcacggatacttctaaattactattctttatgcacttaaatcttaagagaaatcttgactaacctagaatatttatctttacataattatcatttcaacaggtttaatatacgttaaacttattactttgatttatcttgaagttaaaaaagtcatcaacgcaagcacacaaacaaaagtctgaaacaatcttaattattccttcacagtaaggctactaaactagcaactaaggcagcacttaacaatccccaggtcagcatctttaattcacgatggggcctctccattcatctcacaattccccaactatcactgctcctgctgtcagaagattgttgatacgtggcccaggagagttgctgccaacttcccctttccaagttcagaagttcctctaatcaaaaatgaaaagaagaccaaaaacgactaactttcacccttttacatgttccagcccaaatttacgaaaggtcacatttaaaatacacttatctggaaacaagggttgtttaaaatgggctcaagaaaagccgtacacccttgttatgttcctacacaaacaactgtgtcccagatgtggaaaaaaacaacctgatggtcttttacctgcagaatcacatcacccgtagagcacaaactggacacatcctcaacagtgccccagagcactcacacagaacccagcagccttgcgcttcagttcttaaaggctccacatttactggctttagcaatgaattcctttagcagagggccatccatttgccaaaatgctgcagtctgtgtaacttctgtcaaatgattgatgcaaaacttaaagcagaattcttctaaatcctggacacacaacaaaaataaaaacaaaaatggcttttttaggcaactttgattgaattacttctctctgagccctttaccccaaatctctcaccctcccccagaaaagatatttgagaggccagatacctaaaactaggcaaaaaggtgaccacaggtaggtgtgagaaaaacacatactatttattcaacgcagtaaaagcaatggtcctctaactcaaagtacgactcttcaaaacacacacgcgcgcgcacacacacacacacgcaagatctacaagggaaagaatttcctgcacgattatcacataatctagttatgctcaaagacattgttgtaaaaggcagaatgccactttagtctgcagaatgtgttttgtcacgttcaagacatcagagaaaagaattaagatgtgggttagtttaagaaacagaaaggtaatgaagagatatggtcaacctaaagtggcacattaaaaagaaaatcccagccgggcacggtggctcacgcctgtaatcccagcactttgggaggccgaggcgggcggatcacttgaggtcaggagttcgagaccagcctggccaacatagggaaaccccgtctctagtaaaactacaaaaattagccgggcgtggtggtggatgcctgtaatcccagctactcaggagactgagacaggagaatcgtttgagcctgggaggcagaggttgcggtgagccgagatcgcaccactgcactctagcctgggtgacagagcagaggctctgaaagaaaatcccaaaaaattcaccttaaattcacttttatgctctcctaataatgactttatttttaaagccataaagaataataacactacaacttccaccacactaatatctcagaacatcacccccacagaagtatatttacacaggttagttttcagtcaaacagaagtcaccaactaccaacattcaggggagtaacatccacaaggggtaaaccagaaccatttcaaaatcaatccctgcctatgctaatccaccctttcatcccctgccaaactttaatatagtctgtcccttaggatgttggaatatatatttattaaatcgattaggcacctggaatgcatacaaagactcaatatataaaaggaaatcacactaaaagctcttatcacaaatagcttgactttattacaacttggttagctggtacattgaaggtcagcactccgggttctatcgaaccagaagctcaacatttcaactgcaggttttgaccgcacatttccagctaccacgaggtgggaatgttagacagagtggaaggggcccacacaaacatggagagaccccttttctgctctcagcacagacctctgcaaacaatgatttccttgttctaagggtcctcctgtccctggctaaaagatgccctagagtaaactccagaaacccatccagtcacataaccattaagagataaaccacaggccaggcgtggtggctcacgcctgtaatctcagcactttgggaggctgatgcgggcagatcacgaggtcaggagtttgagaccagcttgaccaacatggtgaaaccccgtctctactaaaaatacaaaaattagccaggtgtggtggcaagcacctgtaatcccagctactcaggaagctgaggcaggagaatcgcttgaacccaggaggcggaggttgcagtgagccgagatcatgccactgcactccagcctgggagacaggagtgaaactccatctcaaaaaaaaaaaaaaagaacttttatacacaatataggtataaaaatggtgccactaatcacaattcactttatacactcatgaaaatggttctatcaaactgccttcccttcccctccaattagtttgaactactgaggtatctgggtatgcaataaatattcaaaagttccaaacattaaaagccaaactagagaattctgaaaacaatctaaatctgggttgtgtaagtaactaattaaaccttggttgaggcagatctatgtaaaaggaagccctgaacgcatgtggtgagggacgtttgaatttgcaagttcaccagagagtcgcacagtcaagctgaaccacttagcaaccagtgcccagggttggtttgcctttgatgagcaagttagacaaacgcccttccgacttgacctctctttagtattataagaatctacataatctgttcctttcattctgcaaaggatcaaatcttcaataacaggcaagaaaatgcaactcctgtccaagtgagaagtcaactataacagggctggttatagttgacttcttacttctaactgggctttaaataaaacagttccaaggaggaccagaaggatcatgtgaccaggagatgaacaaagttcccgacagaatgaaagtcctcttatagcccatggaatagggaagtggagagtataaaaacagaagggtctaatacagtcttcttggtattagaaactaaactctgtttatgacgttatgtggcagaacaattataaagtgttctaaggcaaatgagataaaataccagatttattgtcattagcaaagaagacaaaaataaaaactgctcttctgaagtaatttataaatcattccaaatctttcaacattgaaactattccaattcaatatatatactctgaaaataagctgtttttcctttccacaaattttctttagtaacaaaacaaaacacagagcattgatggtcttaatatcctcattttaaaaaatgctaatgccgcctctaagggagttcttaccctgtcctaaaactccaaagctaaactagttgaatgttaataatttgaagaccacctaaccagggtgagcaggtgcctcggcatcacagctccccacaagacacattccagatgacacaagatcacgaaccacacctaactctgtccaacctgttgttaaagtaactgcaagacaaaaccccaaaactgtcagtctataattcatgttatagcacatcaagtacaaaatattccaaatcaaagaagttttgttttgttctcaaaatgtacttaaacattctaccatatggagaaaacataatttatcccattacgcaaaaaacatttgtcagcctactgctgatcaaagacttttcatttggcccaccaaaagaagaaaaaaacgctggccaccaagccttaacaccaagctgtccaatactcataccccagaccaacttcagaattagattcctgggctcacgtttatcgcttccctccaaaagcaagatcgtaagatataagttgcttagcacacaggatttctggaaagttctctactctggttaaacaaataatacttcccagctgtttctcttaacgttcaaatacacataaaaataaaaaatttcctgaaaagaatcagtttgcattgtgcaactgatctatcttgaaacaatgttttatccacattttctccctgatgtcaatatttattcaggtctgtaccaaaggagtatctgggtgctcctttgtgaagtccttcttaataaaacttgtggacagtttcataacacgttcatagcaagggatccacaatcatcaacttacttttgaaactccctgtaactactgagtccatacatttttgttgctttaatgtgtgtacatttgcttcaaagctatcttgtcaaaacggggcatggaggaacctcaggtactttcgtagaaagacaagaaacattggaagcaggtagtctccatcttcctagcattttggcccacagcacgaaggcaaagtcatctagcatccccaagttgagctctaaaaataatagtttttgcagtcaatttctaacctgactcatcagtagcctccaatcaactaataaacacagtaagagggctttctttttaagagatggcagtctcactatgttgtccaggctggtctcaaactcctagcctcaagcaatcctcccacttcagcatcctgagtagctagaatacaggcatgagccactgtgcccagctatggattttaattttgtactccagaacttcattcatgtactcactgtatcttgtagcattcaggaaataaaatgtaaaagcacattagtcaattacgtaacttgtattgtaacctaagaaatacaccctagaaagaggcctggcgcagtggctcatgcctataatcccagcactttggaaggctgaggtgggagggacacttgagcccagaagttcaagaccagcctgggcaacataatgaaaccctgtctctacaacaaataaaaaataagaaattagctgggtgtggtggcacacatccgtagtcccagttcctggactgggaaggaaggaggactacttgagcccaggaagttgaggctacagtgagctgtgatcacaccactgtgcttcagcctgggcaacagaacaagaccctgtatcaccaggaaaaaaaaatacatacaaattatgaatatatatatatacacacacacacacatatatatatatgccctagaaataaagaggtgagtctttctttttgtcttctttctattctctaatttttctacgttgaatctgtaatatttgtaggattttaagttttttttaactttttttttttttttgagacagagtcttgctctgttgcccaggctggagtgcagtggtacaacttctccctcccagattcaagcaattctcctgcctcagcctcccgaatagctgggattacaggtacgcaccaccacacccagctaatttttgtatttttagtagagacagggtttcaccatgttggccaggctggtctcaaactcctgatctcaagtggcccaccttggcctcccaaagtgccgggattacaggcgtgatctccaagcctggccatttttttttttttaagcacaccttcatggtgaggtatttcaaatgttttcactcatttatttaattcaacatgcatttttgagcgccagctccatgcccacactgtgacagactctggggaatcacacttatttggagtctttctaaaggaagtttttatcatgtttatacttaatatgagaaaaatgaaaactagtaaaggaaatgacctgctggcacaggaagcagcagcagaggctttttctgtaaacttcctaggacagatcttagctaaaagtgaggaagaagtttccagcaacttgagccgagacatctgcctctgcccaggttgttctcactggtgttagtcagcaaggtctgatcctgagtatggaactcgttaacaaggaggaggagcgtggagaggcccagagaggattctaacatccgtcaccaaatggacagaaaaggcactaacccaatttaaaattatatcaccgggtggaaataaaatctaaagaaacagcttttctaataaagaggttcagggtgtcacaggaaggacaggaaaaaaatcataccccattttctattagaaatgatttactttgatcatcattccatctgttgtcgggctgcagacaaagtcagctacatttgaccttatcaaatatttataatcagaatatagcctcaaacaaaaataagatacattttgaaaacatcgtggtcaactttgatccctatgtgtgatgaagtgtgtcctcttatacctcaaaggacacagctgcagatctttgcaggtgtttgataaactccttgataccagatattctgctttgtcaaatgacaaagtatctgcaaggataggctaattgtaacattctacatgcacaacttagctagatattttgaaactccaaggctattgctctctaccttttattctctctgaatctgtgaaaccaaccatacccgccttcagctcactgatcatccttaatgcttcctttaaggtactatcttcatccagttcaacatttatcaggtgcctaatatgtgccaggcactatagggtatacagacgaatgagacagttcctgctcacgaggagcttacagtctgatgctttggttcttcaaaaaaatgcacacaaactttcagactccccaaagcccattaattcacaggctcaacagatctgtgaatctcagattaagaactcaacccagtgcaaaaacaaaaggagtccacagcaagttcttaacaggtaaataactgtgagctgtaattagacactaatagaattgcagagcgtacacagatacaaatcatacacatccccagcttatgacagggcagaggtggaaagacagcaaggtaagtctcgaaataaacacatatgctgacattaagaaagacttgaaactaaaatatgctgtttgttagtccaattagttgtggcaccttatgttccaacctgcagcacagctgctaggaccttggttcgtttcctgtcttacttagaaatgaaagtagaggaacaacgacttttgaaacaatgaacagggaattaagaagcaagggcagatttcagttttcaatgggttcactgattccctaaacagaagtggagtgactcatcgttttccatgcctcacgcaagaagcgggggagacgagcacaaagggagttaaaggtggtctggtttctgtttgttgtttaagttacctctgcatcatatctgactgcagcagagaatagcgaaaaggcattctccacagtaattcctctcttgataatgtgctgacaaagttttttcagtctgttttcacagtaagatgtcgccaaatccagaagacctaaaagtaaaatatgtgaaaggtttaatcaaatgtataataatttccaatacacagagattttgttttggtgaacagaggtgtacaggtaaattagaagtttcttagtggataagattctgaatttgagtaaataaattctcttttttactgtctgcctcctccacttccacacctctcctatatttactttatacaatttcttcaatagtgcaaagaaagagcaaaaaatgcaatttcaatcctcattttgtttctaaaacgctaaatgcattagcaacttatacttcactactagaaaattaaaataagcccatagcttaatacctaggtgatgggttgacaggtacagcaaaccaccatggcacacgtttacctatgtaacaagcctacacatcctgcacgtgtaccccagaacttaaaaataaattaaaaaaaaaaaagtccttcagtaacattagaacaaaaaagcctatggtcataaactaggtccaaaactattaaccataataactacacaatactacttttaaagatacttacttcaaatcttttttaagcaccaaattaaagccaatacacctgaagctttttacatttcaggactaagaatatgaggggatatattctccaccatgcggctcgtccatcccaatgctaccacagtacctatagcatcttctggcggcaggtcgactgtgtctgtgtagaggtactggagaaaggcacgatacactgggtaagaaaactgatcgatttctatcacttccttcatgtcttcattccaatacgactggaacatggatcgaaaatgctcacacctaaaacagcaaagcaaaagtcttatttgttcagcagcaatttttaaaaaagaaaaaaaaattacctaattaagttgataaaatcagataaacagaagtatccttgggccgggcgtggtggctcatgcctgtaatcccagcactttgggaggccaagcgggtagatcacctgagatcaggagttcgagaccagcctgaccaacatggataaaccccgtctctactaaaaatacaaaattagctgggcatggtggtgcatgcctataatcccagctactcaggaggctgaggcaggagaatcgcttgaacccgggaggtggaggttgtggcgagccgagattgcgcttctgcactctagcctggcaacaagagcaaaactccgtctcaaaaaaaaaaaaaaagtaagtatattaactactatctgggcctgaacacaccaggatcacagacctttagttagcacccaaaaaacattccacatgcaagtggtttttgtacatgccttttacatacactcactttcattttttgtaactcctattaaatactaataggtatacatagagcctggaagtacctagcacttccactactgtttccatttgatggtccccaagatttttttgctcctttgttttttttaaaatgatgtacagaaatgcattttaaacaataaagtgaaagaaattcagaaacaagagttcaaaacttttgactatgtatcaacattaaaatgattcatttgttttttgttttacataataagcatattcttaaaactgttttatatgttaactggattacatcaagctgattattgtctgattatccgacaatttttcttcttttctgacttatcgtcaaaacagccatcactccttttttttttttgcattgcctgttccccttcctctcttcccaggcctgctacaagcttatttataaaacactcacatccactaggatagtcagatatttcaagaaaacctgagcagctcctacactgtatttacatgtacaaagccacctgcacaagaaactgatttctgaatattggattttcttatgtataacacagttgtatctttctaaaaatcatatttttaaattattttaaagtgagatacggcacaaagagaaaaagtattctgaggtgcagtggctcaagcctgtaattccagcactttgggaggccgaggcaggtcagcctcaatcacctgaggtcaggagtttgagaccggcctggccaacatggcgaaactttgtctctacttaaaatacaaaaattagctgggcgtggttagtgcacgattgtaatcccagctacttgggaggctgaagctggaagatcgcttgaacacaggaggtggaggttgcagtgagctggtattacgccactgcactctagcctgggtgacagaatgagtctctgtctcaaaaaaaaaagaaaaagaatccattcagaatactaaaaaaatagtttcacttacataaaaaattacctgagaaataaaaaagaaatagttgtctaagaaagaatcatggatttcatggtcagaaaactgtacatgaaaggaatagactggttgaccacaggtgcacagacagaaacagttccagttcatcttttcaattaatactgtggttcagatatttactcccttaggtaaggaatgacatagggcttttctgttcctttcaaatgtatttctttgccaataggtttttacctaaatttccaaaaagacttgtaaatggccactttaatggtcttagcttatgtgcctttttctgcaatggcaacctttgtggcaaacagttactaataaacgcataggtccctcacatttatacaaggaactatatcttaaaaactttttttttcatttttgagataagatctcactctgtctcccaggatgatcacagctcaccacagccttgatctactgggctcaagcaatccttccacctcagcctccagagcagctggaactacaggaatgcaccaccacacctggctaattttttctattttttgtagagacagtgtctcgctatattgcctaggctggtctcagactcctaggatcaagtgatattcccgccttggcctcccaaagtcctaggattacaggcatgagccaccatgctgagcctagaacattcttcaattggtaattgcatgtcccttagaaacagaagcacagcattcctatgagagttttctgcttaatctataattaaaagagggcatatacacttttcaataacaaccttttgtattttctttaaccacgtaaataaattttctgatggaaatgagtattcaccagattcttaatttaaaaaacaatataagctgggcgtggtagctcacatctgtaatgccagcactttgggaggctgaggcgggcagatcacctgagatcgggagttcgagaccaacctgaccaacatggagaaaccccatctctattataaatacaaaattagccaggcatggtggcgcctgcctgtaatcccagctactcaggaggctgaggcaggagaatcacttaaacccgggaggcagaggttgcggtgagctgagatcgtgccactgcactccagcctgagcaacaagagtgaaactctgtctcaaagaaacaaacaaacaaacaaacaaacaaacacaaaaaaccaatatggacaaatacttaaattcctacattacactttttctaaaacgctccatgagtgtacacaaaaaactctttgacatgaaatggactgatactatctgcaaaaatattaagtagtgacatttctctctactaccaaggctattttttatcagtactcattttgtggaataacaaagaaagaaaagtcaagttattgatgtctctgagctcatgcaaaaatacctgattttcaaaacagctttatggacatgaatatattttccatcaattcgaaacttcagatcagcagtttctggactatcaaattctttcttcagtgactctgcaactgttaaaaagtcttcatgctctgaaggcaacaaacatatattaatatggcaagttcaaggaacagattgaagattcaaaagacttcaaaaagatcatcatgaccgtgatggataattccacttgtttttttttcaagagttcataccttgtttgacaaatcaattctacggtattaaagtaagtatcctgcatctataaactaccaaagaaaaccaccaaaagatggtatttagaaaggctaaataccatcttatatgcctagttatacattagaaatgtatatttttaaagaaaaaaattataggtacttcatgataatataataaccccctctcaaaacgagtggttctcttctaagactaagaatttgtttcccttgactgaaacactaagaatatcttttttctgctttggggtactttcaaggggtcagcatacccaactcaaggaggtgcaagaaacaaacttaccacttaaatggtaatgctaagcggtcatgttctcaagcagagaaactctttcctaagtatctggaatctaaacatctctgttaaccctaaaaatcactatatgcataatccttactcactgtctaaacacagagcaaattcacttagaaacaacacctacatgaagggaacagttttataagaacacaggatcaccttacctgataagaagaattgctgttgtggttatatgttaagtagaactgtgttactacaaggaaaagtaaaggcacttgtacaaattcccggaatgctttcttgtgttttatatgtatgaaagaagaaaagaagcagaaaagggctaatggggaaatttttttaaattccagagatcctgaccaggcatcgaatcaagctgctatggatacacgaagcaggtttcaactgcccacagctgagttaataatcagtgtcttaatcaaagacctcggcttccaagcctgggatgaaccattttcccttggtagcgtgctgttaccagagcaactcctagaggagggacaacagctaaaacctaggctgaaactcaacaaatgagcttatctgcaagctttatcatcagactctcccccaaggcattacctttcacctaagccctgtgaccttaactgacagccctccctccaccccatgcaatgcagagctctcctggctacagaggaaaggtagaaaacctctcaaaagtcaggcttcccctgaccttgcaacctggatcactggtgggtaaaagaatacaaatgactaagatgggccaagagtccaggagtctagattgctacccccacccatccaaaaaaaaacccacttctcatcagtgcttcaacttctgcatccagtcttaggctgaaatgactctttctcctctttgctcctggcaacaagtatagtacatcctttcagagaagaaatcctcctcaaaggggtgaattcaccatgtgactttccgtctaacactcagatgagatcacaaagtgagagggaaaaaacacttttgactttcagtgggtggaagggaaagaagttatctaggacagcagtccccaacctttttggtaccagggaccagttttgtggaagacaatttttccacggaccgaggcggggaggaggatggtttggggatgattcaagcacattatgtttattgtgcacttaatttttattattgttacactgtaatatgtaatgaaataattacacaactcaccataatgtagaatcagtgggagtcctgagcttgttttcctacaactggacggccccatctgggggtgatgggagacagtgacagatcatctaggcattagattctcataaggagctcgcaacctgtatccctcgcatgtgcagttcacaatagggcttacgcttctttgagaatctaataccgctgctgatctgatgggaggtggagctcaggcggtaatgtgagtgatggggagcagctgtaaatacagatgaagcttcgctcactgccactcacctcctgccgtgcaacccagttaataacaggccacggaccagtacaggcatatggcctggggtgtggggacccctgatctaggaggatatagtcaatgaccatattttttccaaacttaacatttaaattgttaggacatttgttctgaaaagaatgcctgtgccattttaagatataagaactgggggaagccttttataacaagtccaggttaagtagtatatacaaatctgaagatgtgtacagaagtgcttcagctgggtatgccatacatgtgcaattctggccaaatagtcccattcagtgaaccaattattttccaatcacaatactcactgcaaaaaaaaaaaaatactgtattatacctaaagaacatggcaaaaataaagtgaaagggagtattcaattggtttcactttaaggcaagcttaactcttcctaagcacccttgcctccatgcccatgactggtcacctaattgggacaactccacctgtctgacacacctaagcatgacgttttagaaaattaaccttcaatatcaattgctgaacaacccaaacaccttaactgccaagaactacattaattttcaagcacagagcatcatgacccacttattccctctgcttataaataaaacaacttaaaagaaatatgctagcaaaaaggcaaacataaacaagaaataaaataaaaagattaaagtcaccttgtaaatggctactcagttttaagacatcctagctttttcagccaataatggactcttaaagaagacaatattcagaaaaggtacagattatgtaaccaaatatcaccccaaattccactaccctttataatacctctgttttgatgcccttctgaaataaaagaatttgaaatcagttgaaagacaaagatagaaagaaagaagatggggttaatgtgtcaccttaaaaaccacaagttgtttgctttttttattgagacagggtctcgctgtgtcacccaggctggagtgcagtggtgcgaccacagttcactgcagccttgacctcccaggctcaagcaattctccacctcagcctcctgagtagctgatactacaggcaggcaccaccactcctggttattttttgtagagatggggtttcgccatgttgcccaggctggtctaaaactcctgagctcaagcaatccacccaccttggcctcccaaagtgctgagattacaggtgtgagccaccacacccagccggttcttcacttttttgaaagttcatttttggaccaggcgcagtggctcacgcctgtaatcccagcactttgggaggctgaggcgggcggatcacgaggtcaggagttcctgaccagcctgatcaacattgtgaaactctgtctctactaaaaatataaaaaaattagccaggcatggtggcacgcgcctgtaatcccagctactcaggaggctaaggcaggagaacttgaacctgggaggcggaggctgcagtgagccgagatcgcgccattgcaccccagcctgggtaacagagtgagactccgtctcaaaaaaaaaaaaaaaaagaaaagaaagttcatctttgattggtattatatcaagttctgtaagaaatctagtataacagaagtgcttaagaacaggctacccaaaaacttatacaagaacagtcatgacagcactacccacgagagtcaaaggtgggaacaacccacatgtccatcaacagttaagtgacaaacaaaatatggtgtatatatatataatggaatattattcagtcataaaagggaatgaaatacagagacatattacgtcaatgggcctcaaaaacattaagtaaaagaagccagacacatgggtcacatattgtatgcttccgcttatatgaactctccagagtcggcaaatccatagaaacaaaaagcaaactagtggttgctaggggttggggggagaggagaatggagtgtgactaattaacgtataagggctttcttctggggtgattaaaacaatttagaatttgacataaagggtggatgtaggccaggcacagtggcaggtggatcacctgaggtcaggagttcgagaacagcctggccaacatggtgaaaccccacctctactaaaaatacaaaaattagctgggtgtggtggctggtgcctgtagtcttactacttgggaggctgaggcaggaaaatctcttgaactcgggaggtggaggttgcagtgagccgagattgcaccactgcactccagcctgggcgacagagtgagattctgtctcaataaaaaaaaaaaaaaaggtggatgtacaacattatgaatgttctaaacgcaactaaactgtaccctttacaatggttaattgcatgttatgcgaatttgatatcaattgaaatgaaagcacttatgagagaaaatttaaagttcatggtaatattttataatatatgaatacatttgattatgcacatctattttgacggaacgtatgaaagctaatagagaataaaacattctgagagatcccaaaaccagcaaagacacaggaaaactggtcagttggtagtaccattcttcctgggtggaggtggccctgcactttcttacccacagacaggaggcgccacgagacggcgggagtggcaaagcaggcaaacacgtcgtcggtgcaggagaagtgggtgaggtgcgggaggatcacggactgaccccggcactggccccacatgtacacgtgcccaccctgcgtcttggctgcagacgtgtgggcagagtgacaggctgcaatctctaccaccctgaaaagttttaagaaaaatgcatgttacttcatgatcacagaagcccacagcacaccacacaaggcaatttaaaagttcatgcttgcaatacctcagaaaacagtccaagttccagggacactagctgccaagtcacagcaacaaaagcaacagatcagggcaagagcactgttctcctttcccaaatgcccacttctcatcctcagctcactgtgagttaggatagatcacacagaccgccgaggaaaacttggaaaacagaccagcaaatccaagcaaatgaggaaagtggacactgagaaaatgccctaacaaatgtgatggcttaaataccatttcttttttttttcttttttgagacaggatctcactccgtcacccaggctagagcgcagtggcatgaccatggctcactgcagcctcgacctcccaggctcaagcaatccttccacctcagcttcccagaccacagctgcaccaccatacccggctaagttttgtattttttatagagacagagtctcgctatattgccagggccggtcaccaactcctgggctcaagtgatcctctgccttcgcctcccaaagtgctggggattacaggtgtaagccatcgtgcctggcccatttctttataaatgtaactttttctctcatctcctaccagagctcagaacactcattgggctgataagcattggctgggggtcacggactctgaacgttccaatccaaaaggaaaacaagccaaacttactatatttctcagtagtatgcttcttgggtaaggtctcataatcagaagtcagcactccaggacataggaggtaagaccttacaattaggctgaacaacatcaagcatctattccagtaacacatattatatcaaatcaatatttaaacagataatgtcctttcaagagcagatttatttaaaagttgttttacttggctcaaagtaaaagtttatattacaccataaacatcaacatggccatagaccttacttgtcttccatactaaaagggcaacagcaagactgcagtaattataccaagatgcattcacacctatcaatcacaggtggttatttcagagagctacataagaatcatatcaacctcatgttcattctggctactactcaaaacacttttgcataggccaggcacggtggggctcatgcctataatcccagcactttgggaggccgaggtgggtagatcacttgaggccaggagttcaagaccagcctggccaacatggcgaaaccctgtctctactaaaaaatacaaaaattagctgggcatggtggtacacacctgtaatcccagctactcaggaggctgaggcagaagaatcacttgaacccacgaagtgaaggttgcagtgagccgagatcgtgccattgcactccagtctgggtgacagagactctgtctcaaaaaagggaagggaagggaagggaaggggggagggagaagggggaagggggaagcagggagggagaaggaggaagggggaagggagaagggaaggttatctcttttgtccaaaatgagaatgttaataaacagaagaatcacaaagccaaacaccacagctctgccacacacagccccaaggccacatcgcacacacagtcccaagacgtggcacagccaagttacctttctttctccaccatgatgtgtgctgggcttagcaggttatttttattgccagttcccagctgcccatatgtgttagctccccaggcatacagcaagccctcatctgttagtgctagagtatgtgcgtaaccgcagacaatctgcaagtaaattgaaacggttaccattagcaggaaaacaggaagggcagggagaacatctacttaaaggctatagccagcttctgcagaatgccaaatcatcatcaggggtggactgacatttgctggaacattaaaaaagcattagaaggccgggcgtggtggctcatgcctgtaatcccagcgctttgggaggccgaggcaggcagatcacaaggtcaggagattgagaccatcctggctaacacggtgaaaccccgtctctactaaaaatacaaaaaattagccaggtgtggtggcggccatctgtagtcccagctactcgggaggatgaggcaggagaatggcgtgaactcgggaggcggagcttgcagagagctgagatcgtgccattgcactccagcctgggtgacagagggagactccgtctcaaaaaaaaaaaaaaaaaagcattagaaaagcctaaaccttaggctactgaatttttccatttttttttttttttttaacttgtcgagcctgttttgccaacaccatagtcttgcttctcctcgtgggaaattagggaagatataatattaaatatggaagatgaaggcacagagtattgccagaaaagactgactgaagagtaaacctccaatatttctccaagttagagcaaggaaggtagatgggaagccactaactgagagtgcaccacacgtacctggttcacacacacgctgtgcaaagctgccactctcacaggggtcagctggttgccattgtttcccaggcccagctgaccgttgccattgtaaccccagccatataccttagagaggacagaagggagagagtgagatttttaaactgctggtaagaaggaagagacaaaaaaaccagcccatctaaacaaatcagatacttccaacacctatattctactctatgctcctgcaactgatctccaaacagaagctattttggagaaggggatgacagaattggcatcagtttctactccatgacttactagttagatagtctggggcaagtcactctttcctgtttaatacatgaggaagttgagcctcactaacaattattaagtacctactgtatgtcagaacactctgaaaggtactagtttttggtcacagtttaacaggcgaaatagatacatgcaaattttttgctgatgggtagcaagtgctacaataggtataatcaaggcgctgcagaacagcaaggaggaaggctttagctctaggaagaaagattaaggaagacttttcaaaaagtggagattggagcagagctgaaggatgaaggagagcaaaaacattccaagcagaaggtattgactgtgttagaagctagtttagaagataagtaggtgggcttggctggacacaactgcggtagtggtagtagaaagactagaagaaggctgggtggggtagctcacgcctgtaatcccagcactttggaaggccagcgtgggcagatcaccaggtcaggagatcgagaccatcctggccaacacagtgaaaccccatctctactaaaaatacaaaaattagctgggcgtggtggcgcgtgcctgtaaccccagctactcaggaggctgagacaggagaatcacttgaacctgggaggcagaggttgcagtgagccaagatcgtgctaccgtactccagcctggcaacaacaacaacaaaaagactagaaggaaaggcaagagctcagagggaaagtgacaaaaaacctaccagggaaagtgcaatacatctataaatttctcattgaaatattaatttaatttgtatttttgaaagataatgctggccacagtatgaaagatgatggagcatataaggctagaggcaggaagaacctttaggaggtcatttcttccctcgttagcaaataggtgagctctgatgaggctctaaactaaggagtgatagggggatcatgagagggaaagcagaggaaagaggattaaaaatagaagacttcccagaacgtgacagtcccttggatatagagtgagaggaggcccatctgctgaaagtaacagagctaggcataggtttgacaggagtgttaaaggttccaaatagccataggaaaaagtactgaccaggaacaaataaaggccttgctcaaattacaaacccaagatttgtggtggcatcgagccccacagcaatgtagggcggcagacatagactggggcttttcagggtaacatgatggagcggaaagggggaatggactttaagggcctggggagagatggttaaaggcactttcacccagtgccagaagtgtaacagacatgaactttctggagagaaatttggcaatggctatcagtatttcaaatggcatacttcttgacccagaaattctttggaaatttattctatagaaatacttgtataagtgtacaaagatacacatacacagagtaacatagaaaatcaccacaactctgtctataacagcaaaaaattagaaaactgacatgttcatcagtagagctctgtatgtgggtcattcacagaagccaaagtcagcagccataatgatggaaagccgcataaatggtctgatcacagacacagataaacacaggatgctatacaggggagcgggaagcaggctgaagaatagcagagaaaagctgcagtaggtataatcatcccatttttttaaaaaaagataattatactcacccatatataattgtttaagggaaaagtccaaaaagatatgcatgaaactattaacaagattgggaaaaggtattcactttttattttatctgtttcacttgtcttcctttactttgttaaaataaccatataataataacctaaaaattaaacttatttttaaaaataagagaagaatactggaatggaggatattcaacggccatcccaaggaattctgaagtcatttcatgatactgagattgattttttaaaaaataagttaacataaggtctatgcataaactctaaagcaccctagcacaggggtccccagtccccagctcatgagccgcaggccggtaccagtccgtgccctgttaggaaccgggccgcacagcaggaggtgagcagcgggcaagggagtattactgcctgagcgccacctcctgtcagatcaatggcagcataagattctcacaggagcacgaaccccattgtgaactgcacaacaaggcatctaggctgtgcgctccatatgagaatctaactcatgcttgatgatctgaggtggaacagtttcatcccaaaaccatgcccccaacaccgccatctgtggaaaaactgtcttccatgaaaccagtccctggtgccaaaaaggttggggaccactgcccaagcacaccaatgcatgatgccaaaacatctgtgtccagggtaatatctttgtataattttcatgcactaaaatatgcataggtagtaaatagcctatttaagtggaagctgcatccagagactaatttcacagaaataaccatcagctcaaaagtgaccacagtagggggtaactaaagggacagttgttaaaagtagctaacaacagtcaggaccccacaaaaaatctgcttttgcaagttgcttcctcctgtgaacattcaagatataggtaggtagttctacaaggacttcatcagttaattttaaaatgtacagttgacattgtttcattggaagagaaaggtaggattaaattctttaatctattacattaaatatcacgaacaaatagctataggcattaggctctttggatcttgcaaaaaatacaacttagacatatagaatctttactttcaggtaaatcctggaatttagaaaagtcatactgaggagcaaaaaacctccagctcctcagtcagtaatcagttaactttcaatggagctaccaaaacaaagcactcttccttcttccatctgatacattcaccttgtgaagaaactgacgtgtaattgaaaaagaaggtagaaagggaaatgggagtggagacacctcacctcgccattgtccagaacagccatggatgaagtctgaccacaggcaatgccaactaccctcttaatatgtaaacagtttgtaacttttcgaggagttggttgatttgctgtagaacctgatcccacttggccacagttgttataaccccaagcaaacacctacaagagaaagaaaaaggaaaaggaaagaatagtcagggtgaaaattctaccccaacacaaataatcataaaaattaaaattatcctacttaatgagtacttaagatgtgctaaacggttctatatgctttacacacattaacctatttaacctgcctagtaatcctgcaaagtgaccctagagtaggtagtacccactttatacatctccgttttatacatggaaactgaaacatgagaggttaagtgacttgcttgaggtaccaaagctggtaagtagcgctaagagaatttaaccccaagcagtctagctatgctcttgaccaccatgctacattccctctataatttgtgtgtgtgtgtatacacacacaactacacatacacacatacgaatgtggcatcaataggaaatgcggtatatgccacataagtattagtgatgtaaaacatttgctcaactctttgggcataaatattcattgttttccatggaaaccattctttttgttttgctttggttttttttttttttttttgagatagagtttcactctgtcccccaggctggagtgcagtggtgcgatctcagctcactgccagccccgcctcccgggttcatgtcattctcctacctcccaagtagctgggacgacaggcgcccgccaccatgcccggctaattttttgtatttttagtagagatggggtttcaccgtgttagccaggatggtctcgatctcctgaccacgtggtccacccatctcggcctcccaaagtgctgggattacaggcgtgagccaccatgcccagcctcatggaaaccattctaaacaagactataaacagagagatgaattagggagggaggtgttggcagtagaggaaataatttcctccaacattaggaaatgtctaagcccccgctccccaccctgcttcacgtggctgcaggaggtggtccacgtatatactgagtgtggcttccatgattcttgtctgatgctggccaaggcaacaacagtagagccctctggtatatgtgttacaggttcatttcacaggtacaaaacaaataacctgcaacacctcctcaaagtatattcacataaatatctagtttaattatgcaaatattaatattcagtataattattcaaagtaccatatgcttaagattaaaataaatcaggaacccagccggcataaattagcaagtttgagctaatttcagcaatcattcttctggcacttctcaaatacatcacattcccttgcagtgctgctgactcttgtttaaaaactggggctatagttccactaaccaagaaatggactaggaaacagtggatctggggcatgaggcctgtgtgctatgcctggctccagcacatcccagtcatgaaatcttggtctccctgagcttttgggtttgttcacttataagttgtcctacttaataaaatctctgtaacatcactgagggacttcaaagagaggaacagtatgatctaatctgtgttagaaaccagagaggacagcaaagcaagactggacagacggatcaacttaaaagatagggaatagaagggactatggcagtagtctaggcaggaaatgacaagacttgaccaaaggcaatggaaatggagaggaacaaaatggaggaacaaaaaggcaaaggaaatggagaggaaatggagatggtacaaaagattagaagacagaatcaataggatgagtgacctttaagataagcacaacttgggggcttaacaagtgttacagtacctactaggaggatagtaaagttattttttccaaactcattacatatactgaaaaataaaatagaccttaaggatggggtcactaaaaaaaaaagtacagaacactgtcacacatctgagctatagtcttagcaaagagcatgggactcagctgccttaaaaaatgaactctaggttgggtgcggtagctcacacctataatcccagcattttgggaggctgagacaggaggatcgcttgagcccaggagttcaagaccagcctgggcaacatagccagattcttgtctctacaaaaaaaaattttttttttaaaagaatgaattctactgccatcaaaagtgtaatcttgattatacaatacacgttatgctagagagagagtgcactcccacaaggtttttagctacatgcacagggctacaatattcacaccacatcaagtacaaatatggtcattaaaatcagaggattttcacaatagccaaaagtggaaaaaatccaaacatccatgaacagatgaatagacaaacaaagtgtggcttacagcaggtccttgaaaaacgtcatttcattcaacatcattttgttataacactaatgagaaaaaatgtcaattcccggccagggccactgtctgtggagtctgcatgtcccatgtctgtgtgggttttctctgggtactctgatttcctcccacaccccaaagctgtgcagactagtttgtgtctaagctgtatacatgtctcaatgattctagtgagagtgagtgtgggggtatacatgagtgcaccctgtatcctgtccagggctgcttcccacctggtgtcctgcgctgccagaagaggctgtggccacatgcaaccctgaactggaacaaacgggttggaaaatgaatgaatgaataaatgaatacaaattattagaaaataaaaattcacaaagtaggcttgtcatggtggctatgcctgtattcccagcactttgggaggccgaggcgggaggatcacctgaggtcaggagttcgagaccagcctggccaacatggtgaaaccccgtctctactaaaaatacaaaaaaattagccaggcatggtggcaggcgcctgtaatcccagctactcaggaggctgaggcaggagaatcacttgtacccaggaggcagaggttgcagtgggccgagattgtaccattgcactccagcctgggcaagaagggtgaaactctgtctccaaaaaaaaaaaaaaaaaaaaaattcacaaagtagacaataaccatacaaatgcataacaataaacaacacagtcaaacaccctcagtgagctgtcacatttgtgatcgtttgcttttgaactgtgtggcagtaggaggtgccccttgtaatttttgctttgcaaacatttattccttgacttaacccaccaccactatgatcaccccaactcagtgattcaccataaattgggtaaataattctcttattgcttttattaatctttgttaaatatatgtattagtttgcatttatttaaatgtttaagaagtggtttgggtcttcagaagtttggtgatgtctttgtgaccagaaatataccataggaacttaactcttgtttttatcaattagccaatggtaaaactggtttcattacatgtctttttgcttaaagttgtagtttccaagaatctatcaatgacattatgtgggcacttactatatgtatccaatggaatattattcagccctgaaaaggaatgaagagaatcctatcatatggtacaaagtggatgaaccttgaggatattatgctaagtgagataaaccagttacaaaaggacaaacattgtatgattccacttacgtgaggtacctagagtaatcaaactcaaagaaacagagtagaaagttgttggctgggcacggtggctcacgcctgtaatcccagcacttttggaggccaaggcgggcagatcacgaggtcaggagatcgagaccatcctggctaacacggtgaaaccctgtctctactaaaaatacaaaaaattaggcgggtgtggtggtgggtgcctgtagtcccagctacttgggaggctgaggcaggaaaatggcgtaaacccgggaggcggagcttgcagtgagcagagatcgtgccactgtactccagcctgggcgacagagcgagactccatctcaaaaaaaaaaaaaaaaagaaagttgttgtcaggggctgggggaggacagaatgggagtgaatgtttaccagggacagcgtttcagttttgcaggatgaaacagttctgtgggtgcatgctggtgacagttgtatgacaaggtgaacatacttaacaccactgaactatacacttaaaactggtgaagctggtaaattttatgttaagtgtatttactatgatgaaaaaaaaaaagaataaagaataaaagcagcatacttacctctccatcagctgccagagccattgaatgatgtgagccacaagctacttccaccacttgcttgatcaagagattggtacagacctggacgggagcaatgccttggttggtcgtcccattcccaagctggctatatccattgtggccccaggcataaaccactccatctgtgcacacaaagcacacaaaaaatcagctccaaaaagaaatagtaaccctgtactttcttccccagaacttcgtacagctccttctccaaccttcatttctctcccattgccccctcctctctattaagtaaccatggacagagtaaaggagagagagatgggtgacagaacgggatagacagatgcaaaatctttaaagaaaaaacttggtaataacatagaaagatcagttttgtgatcaaaagcaaagtttacgtatgcaagaattaggctttctaaaagctttgattcatctcaatagtttctgtgtcagatgccaagaaaaaggcagatgataagaaagctcgatgttaatgtttaccattgcttaaccaaataccaagtcacggggaacccacagggggcgtgtggctactcgctcaccaagtataggggaaagagatagactgtttacaaaggaaacaaaagtctcagggcttctttgaagcagactattttattttagtggcatgaaatctggctgaatttttttttttttttacataaagcaaccatttttttacgctcatttattctgtgtcaggaatttggacaggggacaatgaagatggcttgtctttgcttcacagtgtgtgtgatctcaggaagattaaaaggctggagatgacttgagagttgaggactagcaacacctggaggcattgtcactcacactgctgtgactatctctggaaagcataatcagcttattctaacagattcaactcaggaacagccaaatgggggagacacacagggtaaggtatgcggggatgaggggtgcacggagctcccatgccctccctggcatgccaccccctcccagcacctcgatgtggtcaccaacccggaagctcctctgtctgaattttttttataatgactttatcttttctgagattctgatgaagacaacttttcttgtgttatctcttgaagtatcatcgtttcaggcatttctttccacagcacccccgagtgccaagggcaggtctcccagagttacacattctcctcttatctttcccatggtaataaaacatcctgacctattaaggacagtctgcctggcaacaacactcaagggcaacagcagaaatccaagtattacagttaggctgctggtcactcacagcagtccccaggcaaccaggggaaacagacttctacttgtctactgtagaacgaagacagcccacacaaactcagagtcctcttccaggtgacatgtggctcacaagagccattccctcctacagaaattatgacagaaaccataaatgggaaatttcatcctgagaaagatgaggcttaagactgaaagaaagagtataaaacacaaaaagtatgatccatgatattgtgttaaaagctacggcaggtgaaagaaatgtccaaactaatgagtgttttaacccctgaaaacagaaaaatagacttaaatagagaaatgcataccttgttcttagatgggaaaattcagtatcataaagattctagtttttcctacataaacttataaagtttaaatagcaataaaagcttaaagttactttctggaggtagacaaattgattagaaagtttaatgggaagaataaacaaacaagaataaataggaaaaccctacaaaaaaaaaagcaagaaggtagctaattctaccagttactaaaacctataacaagtttctatgaggctgggcttgcctgtaatcccagcactttgggaggccgaggcaagtggattgcttgaggtcaggagttcaagaccagactggccaacacagtgaaaccccacatctactaaaaaaaaaaaaaaaatacaaaaatcagccaggcatggtagcgcgcacctgtaatcccagctactcaggaggctgaggcacaagaattgcttgaacccaggaggcggaggttgcagtgggctgagattgtgccttgcactccagcctgggcaaaaaggactctatctcaaagaaaaaaaaaaaaaggttaattttaaaataacctgtaattctaaataatctcaaatagaagacgctgaatccatgaaacaatagcaacaagttctggaaagaaacatttaaagatcaagaaagaacacttggaaataaaacaatgggaatgttaaaaatttgacataagcgttgtaagataaagttgaagaaatttcccagaacacagatgggagagaacatttttaaaaaatcatgaagatcaggccaggcatggtggctcacacctgtaatcccagcacttttggaagctgaggtgggaggattgcttgagcccaggaggttacaggtgtgaaccacctgctcacacagtgaggctgcagtgagccaagattgcaccactgcactctagcctggacagagagaccctgtctcaaaaaaaaaaaaaaaaaaaaatttggaagatcactccagaatctctaactttctaagaaaaattccataaaggagaaaacaaagaagaaaatttttctttttttgagatggggtctcactctgaccctcactctgtcacaaaggctggagtgcagtggcgcaatcatagctcactgcaacctcaaactcctgggctcaactgatcctcctgcctcagcctcctgagtagctgagactacaggtgcgtgccaccatccccggcttttttttttttttttttttttttttttttaagagacatggcctcgctatgttgaccaggctggtcttgaactcccggcctggagcaaacgtcctgccttggcttcccaaagtgctgggattacaggcatgagccaccacacacagccaacaagggaaactattcatgaaatattacaagaagaaatttccagaaatgaccaatacaataaattaaaaattacaccagagtacagaatcatgattatgtcacaatacttaaaaaaataaaaataaaaataaaaaaaagatccttgaagcttccaaagaggaaaaaacagtcacatacaaaatagcaaaagttgccaggcatagtggctcacacctgtaatcccaacactttgggaggccgagccacaaggatcacttgagcccaggagtttgagaccagcctaggcaacatggtgagacctcatctctacaaaaaaatttaaaaatgaggtgggaagatcgcttgagcccaggaggtcaaggttgcaatgagccataatcactccactgtactcctgcctgggtgacagagagagagagaccctgcctcaaaaaaaaaaaaaaaaaaaaaaaaaggccaggcacagtggcttatgcttataatcccagcactttgggaggctgagatgggtggatcacctgaggtcgggagttcaagatcagcctggtcaacatggagaaaccctgtctctactaaaaacacaaaaattagccaggcatggtagcatatgcctctaattgtacttcggaggctgaggcatgagaattgcttgaacccaggaggctgatgttacagtgagctgagatcgtgccactgcactccagcctaggcgatagagcgagactgtctcaaaagaaaaaaaaggaaagaaagaaccagtgtgatgccagaaggcatgattacgcaaggcaaaagtgagataatcacctcattatgctcaactccagttatattcataccacatgatgatgctcagatttggatttcacagctctcttgagaaagatgcagagaacttgaagtagattcagttaggagttacaggcacttagaaggctagatactaaaacctgtgacagcattctaggaagctgtgattcctcagtctagacaaagaaaggccgggatgcaaatcatctcccaaatgccaccctagacaattatccaacaaaaagctgaggacctcagagaaagagagcaagagttaatgtatctaaagtataaaaggaagcatttaaatagataatgaattttcagagagtgttgggtgcccacagtacagatcgattacacacacatacaaaatgtccactctcccttagtgatcttgaagaggcagagtaaaaaaggacaagaacctatcaacctgcatccccggttctttcaatatggcaactacatgaatgccagagaacagatgaagatttcccgattcaagatgcaagcaatgcacaaagaaaggaaagccaggtagcatctatgtttagaaaaatgtaccggccgggcacagtggctcatgcctgtaatcccagcactttgggaagccaaggtgggcggatcacgaggtcaggagttccagaccaacctggccaatatgatgaaacccagtctctactaaaagtacaaaaattagccggggcgtggtggcacgcgtctgtggtctcagctactcgggaggttgaggcagaagaatcgcttgaacccaggagatggaggttgagtgggccgagatcatgccactgcactccagcctggagacagagcgagactccttctcaaaaaaaaaaaaaaaaaaaaaaaaaatgccgggcgcggtggctcacgcctgtaatcccagcactttgggaggctgaggtgggcggatcacgaggtcaggagatcgagaccatcctggctaacacggtgaaaccccatctctactaaaaatacaaaaaattagccgggcatggtggcgggcgccagtagtcccagctactcgggaggctgaggcaggagaatggcgtgaacccaggaggtggagcatgcagtgagccgagattgcaccactgcactccagcctgggcgacagagagagactccgtctcaaaaaaaaaaagaaagaaagaaaagaaaaacgtaccaaaggaaccctgaaagttgcattgcagaacaaagaccagtgagctattaaggaataggattgcagctgtcccgctcccgctcccattcccactcccgctccctctccctctctttccacggtctccctctgatgccgagccgaagctggactgtactgctgccatctcggctcactgcaacctccctgcctgattctcctgcctcagcctgccgagtgcctgcgattgcaggggcgcgccgccacacctgactggttttcgtatttttttggtggagacggggtttcgctgtgttggccgggttggtctccagctcctaaccgcgagtgatctgccagcctcggcctcccgaggtgccgagattgcagacggagtctcgttcactcagtgctcaatgttgcccaggctggagtgcagtggtgtgatctcggctagctacgacctccacctcccagctgcctgccttggcctcccaaagtgccgagattgcagcctctgcccggccgccaccccgtctgggaagtgaggagcgtctctgcctggccgcccatggtctgggatgtgaggagcccctctgcccggctgcccagtctgggaagtgaggagcgcctcttcccggccgccaccccatctaggaagtgaggagcgtctctgcccggccgcccatcgtctgggatgtgaggagcgcctctgcccagccccgaccccgtctgggaggtgaggagcgtctctgcccggccgccccgtctgagaagtgaggagcccctccacccggcagccaccccgtctgagaagtgaggagcccctctgcccggccgccaccccgtctgggaggtgtacccaacagctcattgagaacaggccatgatgacgatggcggtttcgtcgaatagaaaagggggaaatgtggggaaaagatagagaaatcagattgttgctgtgtctgtgtagaaagaagtagacataggagactccattttgttctgtactaagaaaaattcttctgccttgggatgctgttgatctatgaccttacccccaacctggtgctctctgaaacgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagtaggccgcagggtcctctgcctaggaaaaccagagacctttgttcacttgtttatctgctgaccttccctccactattgtcctatgaccctgccaaatccccctatgcgagaaacacccaagaatgatcaataaaaaaataaaataaaataaataaataaataaataaataaataaataaaaaagttgcattgcaacacaaatccactgaaaaattaggctggaaggaccatcatttgctatatctaatcatccacagctttatggaggcagtcgaaaacctcagaagtttgcctaatttgcaagacatcctatagcttttccagagttagcccgaagtgtttaactttcacctgctttatgtacttcctctcagaaattaagaagcaaacaatccaaaatcagttatctggtatagccctatctcccctaagcttagaattaaccggtcaatttcttacaaactgaaaagttagatgggttccctccttaccttcggtgctgagaagaacatgtggtccactcccgtaactgaggcttttaatcttctttccacataagccttctagctttttgggtacaagtgtactctggttatctccagttcctagacagttactatagttcagtccaaatacaaagacctagaaaatagatagttttttttctgagtcttttgaccgaaagctgtattaaaagctcccttctctcctctgaaaataagacatttcaactacagagctcaggaggtgaaaagagactgatatggttgttaagaaaaattcaacctctgtggacattgcttacgtttcagaatgtttgtctatattatgaaactcagagtgctatggagtagacgggtattaaatcaagaaactgaaaaaagagaaactatcaaagccatagtcttcctgaacttcaggatctctttatttataccccgccttttctccatctttgaactggacactttgaagaccaattgccaaataagtcctaaaacgaaactaggtttcaagagactcttacctcatcattgtcagtaacgtacagtgcttcactggctgaggtgccgaagacacacgccttccgaatagacgcgatctcttgaggggagagtagagtgaagatgggccactttccgacatccaccatgactctggcttcaagcaattcctataaataagccgacatctctgctggaacagaaaggattccagaaaaaaattaaatagtcactgagctaactttcaaaaaaaagacctgttaataaatactaacaaaagctgattctagaataaatgaactacctttggttacatggatcactcactttcccccagccatgtgtgcaatccctcctccaccttcaaaccccggactttcctacaagagaataacgtgcaagaactagctgtttgtcttgcccacttcctagtcagtgcttatctgttccacatgtgcttccaactcaccctcttcttagacctctaaaaacagccaaagcagcaggtcaagaccaagttctggctccagcacctccaacagcacacacagagggcgcctgcagctggagcatgcttagccaaagccttgtccccacccaccagagatattcttcccaccagcaccaacttggatgacaaggatcagcttcagccccaggtatcataccacaaattcaatgaggattaaacgccgtcaaatcaggctattcattgtcactgcatagccagactactggaataacatttggatgtcttgacaaatgtgtgtgcaggtggagggggaggtatgggtgaggacaagtaaaagatttgacaggggagtaatacatgaaaatgggaaaaaaactttggtttcaaatggacaaaaggggataagaaagaaagtctccttatcatccctccctgaccctctcctcaaaggccaccactgttcccagtgatctgtaattccttctggaaacagtgctcatggaagcactacatgtatgcataggtgtatgtgtatctttaaaaacagaagcacaaatggaagttttttttccctacttaacagtacatcggggaaatcattctatattagcacacatagacctgctacatttctttccaatggtactatggcattccattacatcgatttagcaatttaccttattttctactgagagacatttaagtcaattccagtcttttgctagaacaatagtgcaattgttgcctgcacattattgtattgacatgtcttgttttatacagaaatttctaaaataaattcctaaaaatgaaaattgctaggtcaaagtctaatagctattttactgttactagctattaatatttcaaacagtcttctattgaagtagtggccatatataaaatcaccatggatgtaggatggcacctgtttacacacacccttcccacacagcgtactctcacggcatttcagttttgtttaaactggcatttccctgtgatgagtggagttggatgtcacttaaaaaaataatcaggccgggggaggggggtggctcacacctgtaatcccagcactttgggaggccaaggtgggcagatcaggaggtcaagagatcgagaccatcctgaccaacatggtgaaaccttatctctactaaaaatacaaaaattagctgggcatggtggtgtgtgcctgcagtcccagctactcaggaggctgaggcaggagaatcacttgaacccgggaggcggaggttgcagtgaactgagattgtgccactgaactccagcctggtgacagagcgagactctgtctcgaaaataaaaaataatgatcagaataattgcaacaataacaactaacttactgggcactatgtgccaagcactatttttagaaaatttatatttattcattcatttaatcctcactttaccaataaggaaatggagaaaaagagattttaagaagtggcagagtcgggatctgcacccaggcaacctgaagcctgagtctgaactcttcacctctcactcacattttaagagcccactgtcagccttttgtgcaaagtgcctatctttttctactggatcattgttctttttcttgttcttgatttataagtattctttgtatggtaagatgatcttaaatgcttttaaaagtttaaaaataaaggctgggcgcagtagctcacgcctgtaatcctagcactatgggagcccaagccggaaggactgcttgagcccagcagtttgagaccagcctgggcaacatggcgaaaccccatttctacaaaaaatacaaaaaaaaaaggccaggcacggtagctcactcctgtaatcccagcactttgggagaccaaggtgggtagatcacttgaggtcaagagttcgtgaccagcctggcaaacatagtgaaaccccatctttactgaaaatacaaaaaaaattagcctggcggtagtggcgcatgcctgtaatcccagctacttgggaggctgaggcaggagaatcacttgagcccgggaggcagaggtggctgtgagccgagactgcatcactgcactccttgtctgggtggcagagtgagagaccctgtctcaaaaaaaaaaaagaaagaaagaaagaaaaagaaaaattattagccaggcatggtggcgcatgcctgcagtctcagttactcaggaggctgaggtgagaggattgcttgaacccaggaagtcaaggctgcagttgagccgagatcacaacgctgcactctaacctgggtgacagagggagaccctgtctcaaaaagattaataaaataaacaaaaaggaacaagatgcccctcaaacgacctcttgtgcctcttacaaaacagatggagaaaggagtcataagaagtcaagccatataaagccatacaagcaggtaagtaaatttcaagaaaatccagaagcaggttttcctggaattatgaaccatatcaagttagccttcaaaatgtttaattttacatgacacagaattagccaaaaatatgactcaccacctttaaaattacaacacaaaaggtaagacattcaaaaccacacaacttcctgacagcagcacaattattctaaaatcattaaacaaatatgggcaactctgccctaagggtttggtaatctactgcaagatcaagctaaccttcataatgatggggcattattatacgcactgacttcacccagtgctaaatcacatgaagctttattttacaaggtatttctccaaagacttgtcatttaagagtcaattcaagaaataggtcatgtatcttacatgtccatacccatcataaaagaaaaaggcatccccaacaggcttggtagggtggtaacaacagagtgctgaggcctgtgtcccaggtttgcttttaaaatcagtcagtatgacagctgtttgctgttttgagcctgggtttcccccaaacctagaaatttgtcattttatgttcaagatataatgaagaagctgggggatttcttgaacagataagaacaacagaggcagtaatattggccaagcaagtaattatccctagcaagacaatcaagcaaagctaacagcaggaaagaagaaacgaataactatcctgaacctgccttgtcgtagacactgttaattaggtagcttccatacattatttcatttaatcttcgtaatactcttgtgaggaggagactgtaaaccatttctgacagatgaggactgaggctcaaaggtgaaatgacgccaaggtcacacagcagacccctctaatttttcttatggagaatatcagtcctggcccttgaagggctgaacttcctcaacaacttcagtgaacttcctaaagtcacttctttctgactttatcttgccttgtaaatgtacagcagcatctgtctttaaactgttaccaatataaaaagtatccaggccgggcggggtagctcacacctgtaatcccagcactttgagaggccgaggcgggcggaccacctgaggtggggagttcgagaccagcctgaccaacatggagaaaccctgtctctactaaaaatacaaaattaaccaagcatggtggcacatgcctgtaatcccagctactcaagaggctgaggcaggagaatcgcttgaacctgggaggtggaggttgcagtgaaccgagattgcaccactgcaccccagcctggggaagaagagcgaaaccccatctcaaaaaaaaaagaagtatccactctcccaataaaaagcattccgcaaaatgcttctgcctagatttgcctggttaaacctcatgaatgtcatttattcctgcacttttgcatcaaccattgagaggcaggcctagagaacacatgtgacctctgtcctcggagctcacaacatacaaggtgcatccttgggctggagactgctaaggcacaaagtgtgtcttcattagaccatgcatgctcaacctgggcagctgagaacatgaactggcatccttggaattcagacaaggttccctgagaggttttgtggggctatgtgccaggcagaacaacagaacagggtccttaacttgggcgcgtggcatttccctcctaaggcagcagagcgtaactgtaaataccaccaaaactttctaatttactcaaaattaccaccatcctcattataatttgactattgtggtgaggtctttaattattccattttcctggaggcagtggcaccttttactactgttaagaaaaccacattaaggatcataattatatcaaccttaagaagaattaatgtgtatacactatcaatccaataaactaaagcaggtgcaatctaaaaattaatgagtatttcatctgtgataaaatctacgtcagacttaagaactgtgcggttaacaatgactcaaaaatacaggatctgccaggtgcagtggctcacacttgtaattccagcactttgggaggtagaggcaggcagatcacttgagtccagaagtttgagaccagcctagatgacatggtgaaaccctgcctctacaaaaaatacagaaattatccaggagtagtggcatgcacctggtgtcccagctacttgggaggctgaggtggaaggatcgtttgaacctgggaggtggaggttgcagtgagccgagatcatgccactgcactccagcctaggcgacagagcgagactctgtctcagaaaaaaaaaaaaaaatgcaggatccattgcaaggaacagcaacattatttaggacagctctgatatcatgacatctattaaatttgcctaaacatgaaagaaaagtattaacagacttattctaactatggatttcatttcaaaggaatataaatgtagttcaactaaatttcatttaaataatcattccaggctgggcacggtggctgacacctgtaatcccagcacttttgggaggctgaggcaggcagatcagttgaggtcaggagtttgagaccagactggccaacatggcaaaaccctgtctccactaaaaatacaaaaattaccccgggtgtggtggcgcacgctggtaatctcagctactcaggaggctgaggtgggaggatcatctgagcccaggaggcagaggttgcagtgagccaagactatgcaactgtcctgagtgataagagtgagactctgtctcaaaataatagtaataataataatcactccagagggttgcacaataatttagatgcttcaaataggaagatatgaagtgattctatttgtgttctattcctgtatgaaggaggcactgctaatggaaagaaccttcaactggcctattcagcccaggccttccctgacagtcaagtaccttggtaagtaccctgagcaaggtagcccaactctcttccttcccatggtgctatggtttgtccaaattataagcaccccccaaggaagcatcccaacagaagctgccacccaaacacgtcatacagctaaactatgtgcacatcccaaattcaaaacaaaaccacaaaaataaatgtaccctgtaagacttagttagcttagctatgttataaaacaatatgtcctgtatgattacaatttttctaaagtataatatatacagaaatgtatacaccaaaatatatctccatggagagattacaggtggcatcattttctttctttgtatttttattctattttttggcctgccatccccacttctttagtttgttcgtttgtttgttttcgtcagcagggttgtggccagaaaacaagtcctatcagtctcctacctcacttcccctttagaaattagatacaattcctcatctttttttttttttttttgagatggagtttcgctcttgttgcccaagctggagtgctgtggcacgatcttggctcactgcaatctccgcctcctgggttcaagcaattctcctgcctcagcctcccaagtagctgggattacaggcgcccaccatcacgcccggctaattttgcatttttttagtagagacggggtttcaccatgtttgccaggctggtctcaaactcccgacctcaagtgatccacctacctcggcctcccaaagtgctgggattacaggcgtgagccaccgcacctggccttctttgtatttttaaaatatagtcccaaatttctctcttttttttttttttgagacagagcctcgctctgttgtccagtctggagtacactggcaccatcttggctcactgcaaactccccctcatcagttcaagcaattcttgtgcctcagcctcccgagtagctggaattacaggtgtacaccaccatgcctagctaatctttgtatttttagtagagaaggggtttcaccatgttggccaggctggtctcaaactcctgacctcaagtgatccacccacctgggcctcccaaagtgctgggattacaggcgtgagccaccacacctggccttctttgtatttttaaaatatagtcccaaatttctttttttgggggtggggggtggacagagtctcactctgttgcccagtctggagtacactggcaccatcttggctcactgcaacctccacctccccagttcaagcaattcttgtgcctcagccttctgagtggctgagattacaggtgtgcaccaccacgcctggctaatttttgtatttttagtagagacggggtttcaccatgttagccaggctggtctcaaactcctgacctcaggtgatctgcccacctcagcctcccaaagtgctgggattagaggcgtgagccaccatgctcggccagtcccaaatttctataacaaacactttgtgaccaataaaatgaacaaatatttccaatgaaaataaaagttcaattatttgaattatgttttacccctaggctgttagaagttttaagatgtattcttgctttagattcataacgtagagtggcagaatgtttcaggcaaaatctggaaaaatgaattattaatataaaattaaatgtagatggtagaaatgtaagatgatacagctgctatagaaaaccagatggtgattccttaaaaaaaaaaaaaaacattagaattatattatctagataaactccatttctagcatataccccaaagaactgaaagcagagacttgaacagatagttgtataccaacggtcaaagcagcattattcacaatagccaaaatgtgaaaataatccaaatatccatgaacagatgaatggataaacaaaatgtggtctacacatacgatagaatattattcacccttaggaggaaattctgatacatacaacaacagggatgaaccctgaagacattatgctaataagttagacaaatattgcatgattccacttacatgaggtacctagaacagtcaaattcatggagacaaagtagaattgtgggtgccaggagctggggggaggtaggaatggggagttactgtttaatgggtacagagtttcactttggggtgatgaaaaagttctaggcaacaaatatgtgaaaaaatattcaacatcactaatcatcagagaaatccaaatcaaaaccacaatgagatactatctcacaccagtcagaatggccattatcaaaaagtcaaaaacaaaagatattggcgaggctgtacagcagaggcaacactatacactgttagtgggaatgtaaattagttcagccactgtggaaagcagtttggagatttctcaaagaacttaaaacagaactaccattcaacccaggaatcccaagactgggtatacatccaaaggaaaataaattgttctaccaaaaaaaaaaaaaatgcacctgtatgttcatcacagcactattcacaatagcaaagacatggaatcaacctaggtgcccgttgacagtagattggaaaaagaaaatgtggtatatatacaccatggaatactacatggccataaagaagaacaaaatcatggatgcagctacaggccattatcctatgtgaattaacacaggaacagaaaaccaaataccacatgttgtcacttagaaatgggaactaaatatagggtacacgtggatataaagacaggaacaacagacactggagactactacaggggcagggagggaggggtacacaggctaaaaaactacctattggatactatgctcactacctgggtgacggaattattcgtactccaaagctcagcatcacacgctatacccatgtaacaaacctgcatatgtactccctgaatctaaaataaaagttgaaattgggtcaggtgtggtggctcacgcctgtaatcccagcattctgggaggccaagacgagcagatcacaaggtcagagatcgagaccatcctggctaacacggtgaaacctcgtctctactaaaaatacgaaaaaattagccgggtgtggtggcgggcaccagtagtcccagctactcgggaggctgaggaaggagaatggcatgaacctgggaggcggagcttgcagtgagccaagattgcaccactgcactccagcctgggcgacaggcgtcgcaaaaaaaaaaaaaaaaaaaaaaaaaaaaagttgagatgattttttttaagtagtctagagattgatggtggtgatgattgtacaacaatgtgaatgtacataatgtgactaaaatgtgtaattaaaaatcattaaaatggtaaattttacactatataccttttaccccaattttttaaaatcaaataatcatcctgtgggcttttatcaagactgcattaataaactcaaagatacatttctaaaattaaatatagaaaggtttcagtcctaaaaaatgtgtttggaaaagtaaaatcatactgttttaatcatgtcttgagaatataagttcagattagggaaattctcaacggagcatttataaaagaaatatagccttcttagaattttccagtgcatacagcaatttaaaccagaccaaacaaattgctaagatgacaggtccttccagggcttgtcatcttgataattataaaaatgatgagctgtaattagaatgtcagtcatctttaaatagttacttctgaagtacctcactaagatagtaatttttttgcaagccttccatgttttatttaggaaatactttctgaaaaacaatattaatgtgttgcagcctgaattaccactctttatgagttattattaggtgaatcaatgacttttttttttaactgtataaagataaaacaagggtgcaaggaaagaaaagaggaacgcaaaaatgcaagcagaggtagaaagagtgtaacgtccttaaagataatatgccaacccacttggctcttcgtattttctctggcacttgaaaatacatcctgtatccccactgcacttatcctacgtccattagtcctacagatcaatatcccattccctgggatggcttatcctagctattggcactgtccctcagagaacttgtggcatgaggaagaaaaggttattttactttatactctgaaagcaaattcagtcaggacaaacacaggccttccaattttagaaatctacatttagaactggaaggctgaaggagtaatgtagcaactaatcttttaattcccctaagagcacatttattttactttccccaaggaacaaatattaaggaaaggctaattttattttagtttattttactgatctagcaaaaatatatttcaacatgcttatggagattttaaaaacaacaggaaatggagagaaatggtacaggaaaactggttttgatgaaataatgttctcaatattaaacaacagtggaaatttagggttgatctgtaagcacatggcttccacacagacctcaactaaccagaatgtatttgtttgggctagtttaaattgctgttatgtactggcttttaaatgccaccaatagggtattctacctttagatctggcttctactgaccttagagctaaggaaaagagtgggaaaagagtaagcaatccttcagcattggcgagcaccaagattctgacgcttctggtgtcattttagaagcatgaaatgagtttgtgtcattctttattatggaagccgatagccagaggaaactggaagggctctgaatgttggaacaatcattttaagtagcctaaacattcttcagcatacaagctacagcaagctttaaactactcaaaacagcaacttctaatatgcaaaatgatatttttaattgcaaaaactttgaattaaagcatttacacatacactgaaaattcctaatagaggtttctctatttttgtaaactgaatgggtgatgattttatttatcagtttaagttgctaagctgtcttacgaaaaaaatttatttatagttaatgagctagtgataaaatctaaagggccttggaaaaaagtactattgtatgctaatgtgaacaaaatccagttgtccctcagtatctgtgggggaccggttccaggatctcctgcagatactaaaatccacagatgctcaagtccctgatagaaaatggcatagtatttgcacataacctacacacatcctcccatatactttaaatgatctccagattacttataatacctaatacaatgtaaatgcttggtaaatagttgttaacgtttattgcttggggaataatgacaagaaaaaatactctacatgttcagtacaaatgcaatttttaatatttgcaatttgaggctggttgaatccacagatgtggaatccatggatacagagagctgactttaatagcatacattaattcttcttctgcaatgaccccagataccaacaatgccagggacatcataaagaatacaatcatggtctctgcctctgaggaactgaaggtctaatggaaagtcagatcctaagtaagtggaaaactagaatgcaaatacaactggaataattaaggaaatgaatgtatcatgcaagtatatggtccatgtgacacatgttaatatgtcaaataggaaataattatgtgcaaactagtgacaactatataaaaattgtatataacagaaaacaattacacgaaatcccagaaaccaaattctccatattccagcagatgataaaatgtgagcctttcctcagtgaagatcatccagtttcctagaagaacaaagtgttcttcatagccttcttccttttttagcaataaatgttccatttgagcacaaaagattgaagggtatgacaatctttatttctgaatccatttaattccagaaaaacattcaaataagagagctctacggtttggggtaaactttggtatacaacattacaacttaatgtcttccatctatgctacagcaaaagcaattcaaaaaccctctcaaggtacaaacagccaaatgttactcttaccaatttcttacatataattctgatgggctttttgagactgagcaaatgctgtctcattgagataccaaatgtatttcccaggtccagataagcctctaagaatcagcctcaaacatttttaaataaaaataaaacttaaaaccatttcacccactctatggtataagggctgcaaatcacaggcaaagtttcgaagatgtgctgagacactaatatgttattgccccagctgctagaacagctgtcatccacgtctctcttctgcaaacacacagtactacaagaatgaaagggaggccgggcgtggtggctcacacctgtaatcccagcactttgggaggccgaggcaggcggatcacgaggtcaggagatcaagaccatcctggctaacacagcgaaaccccgtctctactaaaaatacaaaaaaattagccgggcctggtagtgggcgcctgtagtcccagctactctggaggctgaggcaggagaatggcgtgagcccaggaggcacagcttgcagtgaaccgagatggtgccactgcactccagtttgggtgacagatcgagacttgtctcagaaaaaaaaaaaaaaagaatgaaagggaaaggaagaatgccctgaatgcttgactaaggagtctgagaatgtagccttctcccaaagtagtttgtcatccttcaagctgaagccacctgtacaggtgagtgaagataatacccccaccttcatttagagaacagtatgactagtgttttagaattctctgattgtgcctaccctttgtttcataagttttgttcaaattcatcactaattttagaggaaaatgtaagttcctacaactgtcatttcccaaccactaataagttatttgacttgaagcacaatttgcaataatggcctctgtaagcatttctttagccccatcatccaaggggctgctttcatctcattcatttcatctcgtctcacttctaacctcagccatgtgctcgaaaagcaaacgaaccaagtggcaatagcattagcagtgaaaaaaataacatatctagggttgtgcagctgactgagatcttataaaagtattgcttttataggatactgttgttttcaaaaggaaaccagaaaagaaatatcgatgattagaaataatgttttttctgtaagtttgttctttgttaaaccaaacaaacaggtgtcacaaaacagaacaaaaaaaccaatgatgggtcaaagtttaaagaaatggatagatggctgggtgaagtggctcacacctgtaatcccagcattttaggaggcgaaggcaggaggatcacttgaacccaggagttcaagaccagcctgggcaacatggcgagactccatttccttaaaaataaaaagattagccagtcataatggtgtgcgcctgtagttagtcccagctactcaagaggctgaggtgggaggatcacctgagtccaggaggttgaggctgcagtgagccgtgttcacaccactgtattccagtctgggcaagagagcaagatcctgtctgaaaaagaaaaaagaaatggataaaacataatacttcattttattttccaaatgaattcaaggctggaattggtgggtcaaattcaaatctaaatatggtttcatgaatctttctcatgtggataccccaaaagtgatttcatctattagtccccagttgtatgaaaagtatcaactgtaccctgcaatgacctaaagccaaactgaaattccagcaatggactggcagaaccatacactattaattcaataaattttcttaggtaaacaggacacagagccaacaccaacagaaattacatggggttgggggatctagacacataaacagatgctcacaacagtgtggctggtcagatgctgtggaggcaacagaattgggaagtatgcttcagctacctaaagagaagcaggcgcctgcaacagtgagcactcatgccaggtaaggctctggtggaggaactgaaagaaagtcagcatggctgcagccaaacaactcaggctttatcctaagagcaccaggtaatccctgaagggtcttaagcagggaagtggcataaacagatgtaggtctatgaaagattactttggctgaccacagagacatgagacgacaaaggagtgcttagaggaagtccagatggctatggtaagccagaaaagaagggattgaagcccacactagggaaatggagaaaattgaacaagaaggaaaatcaagaagattctgcaactggctgaatgggacaaggagcactggataagcagaaaggcagagccgaagatcacaggcagacgctgagcttgagtgagagagaactgtgctgccactcactacagcagaaagcacagcaggcctcaggggtgatgagtcctactatggacatttgtgccaggtacctgtgggatattaaagtggacaagtcccaacagatggatttagaaatctgaagctcaagaaaggtctggattggagatttggaaatctggcatgaaatcacccaggaaaaaagcaagtgaaataaggagagcagagtaccttaagaagaactctaagaaactccaacgggaaagggacagggagtaccccctagaagggactgtgaaggaagaggtagaccaggaggaaaaccaggagacagagtgtcacagagatctggggacttgagcatcacaggcaagaggcatgctagtgtcgaatgctgctgagacaccaaacgagggaagggtggagaaacttccattggatttaacaaggagaattatcagtgaccttaacaagaacagtttcactgaggttgtgggtggaagaggccaggttgcagcaggttgaggcgtatgtgaaaggtgaagaaaaggaaaccatgagtataaacaacttgttcaagaaatttcactctgaaggaaaaatgagaaatcgcatagtaatcacagaatgtgatagagttgcaggacgttttctgttaacctttttaatgtaaacattgttagaggcttgaacatgtttgaattaatgggaaggagccagtagaaacatcaaagaggagaggatgtaacaactcaatgggccttaagaaagtagcagggaatgggatctgaagcagaagtgcaacagaagcgccgggcgcagtggctcatgcctgtaatcccagcactttgggaggccgaggcaggtggatcatctgatgtcaggagttcgagaccggcctggccaacatggtgaaaccccatctctattaaaaatacaaaaattagctgggcatagtggtgggtgcctgtaatcgcagctactcaggaccctgaggcaggagaatcgcttgaactcgggagacggaggttgcagtgagccaagatcacaccactgcactccagcctgggcaacaaaagcaaaattctgtctctaaataaataaataaataaataaatgcaagagaaactgtagaaaggagcaagtcttccttttcttccttccacaagaggaggaggaaagggtgaatgtgaatgaaagccagtttaaaggttaggaatccagatgctggagacatactcattctctcattctcattctctctccccgctgagtctccattttacatgcccaccggcaatgtacaacagtgctgctttctccagtatttactgtcttttgtattatacccatcctagtggatgggaggtggtatctcatggttttgattggcatttggagaccattctcttctgaggtcacctatttttcccctatgaagaaagagttaggctttttgctaagagtaagaggggaggtagcaataaacagtggagtggaggccgggtgtggttgctcacgcctgtaatcccaacattttgggaggccaaggcgggaggactgcttgaggctaggtgttcaagaccagcctgggcaacatagggagaccctgtctctacaaaaaataaaaaaattagtcgaatgtggtggtgcgcacctgtggtcccagctacttgggagtggggaggatcacttgagcctgggagtttgaggctgcagtgagctatgatcacatggcacactgtactccagactgggcgacatagtgagaccctgtctcaaaaagaaaaaagtggagtggagcaattgggggtaaaatggtgaagtctgaagcagtcaccagggaggatgggaaagagcactgagcagagaaacctagcaggatggtaagaccaagcccagagaaagctggagaccgtaagtctttagaggtacccatctggtctcctctgtgagcttttctaccccaggaaagaagtgtgcttttgtgtatgtgtgtgtgtgtgtgtgtgtgtgtgttttaaatgtgatctaacacacagttgacttatataattatttcattaactgatctcctctactaagtctattctggctaaattcagacaacactcatcatacccctcttgtgcattcttcagcacgtacacaacatgtactttttttttttgagatggagtctcactgtgtcgcccaggctggagtgcagtggcacaatctcggctcactgcaacctctgcctccccaggtcaggtaattctcgtacctcagcctcctgagtagctgggactacaggcgcacaccaccacgcccagctaattttttgtatttttagtagagacggggtttcaccatgttggccaagctggtcttgaactcctggcctcgtgtaatctgtcgcctcaatctcccaaaatgctgggattacagatgtaagccactgcgcctggccaatatgtaacatttttaactttttgtaaaaccagagaatattttgaaatgtgtccgaatgccctgcctagattctagactctgtgaggccccagcctcctttcctatgcatgacttactgtttaatgtagtacacacagaagggatatcatcatcataataaaggtcctcactttccttcacagtttcatctaccccacaatgactcccaggaaaaggagggtactgtttcagacttcccagctcccgtatattaggtggagccaagttcttgctgcagcatacgggcacgctttaaaattttcaaatcattttttaaaagctacaagcttgacagctttgggtttttatggctacttgttttctgaagttcacagaactttatcatttggatcacacacttaaaaaaatcacttgcaaaaatctctttaaagatgaatatgcttcctcttcaagagaaacagactagcgggtagaagaaaaaggacccgtctagagtattaataaatagactgatattcacacaatggattaaatggattaaagtccatcccacagatgaactgttatattaatagaatccaaatatacagttacatcctcgaccctgaaagcagtttaaacgggtgaaattcacccagtgctcacttgaaatgagtactctaaagtttaaagcacctataaactgccctcaggattcaatcatttttccattccttccggcattatatactttgatgttttaatgttattagcccacaatacacaccagtttcagaaactcagtttttgtcctctaagggcttttagtcctcccaaaaaaagaatagggcaaaagcaaggaagatcatgaatctggttttctaaaagcattattacaagactgctttataaaattgtaatccccagctgcagagttccgcagatggcttgaaagtgtcttacatgcaaataaataaaaacaaaaggccacttatgcgagcagaacacagcgtgctcgatagtcatcttaaaccgagcaggtaggtactttatcagaggcagacaagggaaacgtcacttatttagagttcaccgcacgcctggataaaagtcctcactaacaaaatccctgcctttgtggattctgtgtcggaaagggaaacgataaagaatacggtttgtgacagcactactctcaggagacgaaggagagatgctaagatcttggaaaggagagagaataggaagagtcggaggggagatctcctctcagtaaaacggcacccacagcagtcagacttcagctacgagcaaaatcgagtccgtgcacctcaaaaaagagagggaggcagggaaaactttccctcgcctctccccatccttccctcctcctcgcaggagagcacattagctgaggtgctggcgggggccgggccggggaccccatccctcgccccggacgcagcgcccgcagggactgcccgggagcccgagcgagggaggcgggaggtacaggagtaacggggcactcccggcccggcctgcggggaagggaagcaggggcagggccgagggggaagaggcctccgcgagctcgaccccgcgcccacacgctacctgcgaggtcagctgctgccgcgccgtcccgcgggaccgcagggatctccgaagctccaatgggcgcagaagtgcgagcgagcggcggtgcccaccggcagcgaagaggaggagcgccagggcgccgggcccgccgggtcacgtggccccggccgcctcacgtgacccggtgcagcgcgcgcccgggacgctacccagccgagcatcccgcaccgccccggccccggccccggccgaaaccctgctcttcgggccctacaacccgacttctttagaagccgattggccgtctcaggcccgccccgaggccctgccactggagtgtccccatgaaatccggtggctgctgccgggacttagaggcttttgtgtctgaggaaccaggaacgcgcgaggcacgggctcctgctctgctccccgagatggcttggctgtggggagggtcggcctaccaccccagagacctaggacggaaaagcgaccgagaaacttggctccctgcccactctagagcgcgtctggccccggggcaccacccaggtggtgctgcctgggaggaaaggcggcggagctgggactagtttgtttttactggagacgcgcctccctccctccccgcccctcacttcctgattgaaagtacctgaggcaggccagggactagggaaggtggcagctggacaaaggtatgaaggaaggacgagatgaggcacaggtcctggtattggaaagaggcagaggtacctcggaagcatgccatagaggttagacgggacctaagagggcatctggtccaaccggattcgtgttaccagcgagtaaactgaggccaggagagggactgctacgagctgctccagcctatcacctataaagactacagtccctttgtaaaataccatacagctctcggagaactcccagttggcgctgcaggataaaatccaaacttgttggcatagcattccagccacttgttcacttacctttcccatttgagctcctaggaataaacagaaaaacatttcattttctaaatatcaccagataacttcacttttggtaacttgaattattaaaaaagtcctaccgtccctcatctcttgccacttccccaacattactggaggctctggctacaaataatttgttttccttgactactcaactttctttggattatttactttttctctaagtttctttactcctttttgctttgttcattcttttgtctgtatctgaaatgtcctgaatcaccacctcccccacttaaagaaaaccagggccaatgattaaaaaaaaaaaaaaaggtattaagaaactaatgcaataagagaattgagcttagttctgtatctattctgaggtctcgctcctgttgcactagttcctgaataaaatgtttttaccacttcaactactgtttggctctggttttcttcaacagcctccaaagtacacatcagtttcctactcatctttcaaaatccaggtcaaatgccgcctactcttgtcttcccagcatcctcttccctgattttttagcaattgaagttcatccagacagtgtcagctgcaacttcttccctgatttccagaatactatatatattctgatacacctcacactgcccagaaatagactgcgcatttcctgtaaaaggtgaattgtctattgctgtcttctcccttagattataaactctttgaaacaggattcttctgggtttagaacagcgcctggcatgtgatagacccttaatactcactgaatgaagtggcttgcccaaagtagtggcagttgagtgaatttactagaagaggcctgttttgctcaaagaaactaaaatcagtttcttttggttgcaacccgatcaaaagaacttgtgtaaacatgtctgagagaaaaacgagggcatggggtgtgagcaatcaaatatgtcctgagccctcactgcttatgtgtcagatgccatacttggagcatcttggaggattaaaagctgaatgagacatggttgctgataaggaatgtgtagtctggttcattattccagtacagggtgaaaagtattatgatacaaggtgctaagtgaacacaaaccagggaccacaaatcagggagtcagggagaaacttcatgagaaggtcagttggacaggaagtagataagaagaaagaaaaagacattccaggagagagcaatgtgttcaaaagtagtgacacatgaaacagtactatttgtttaggaaaaaacaaacaggtaggtgcagtggctcatgcctgtaatcccaggccaaggcaggcaaatcacttgaggtcaagagttcaagaccagcctggccaactttggaaaaccctgtctctactagaaatacaaaaattagccagctgtggtggcacgtgcctgtaatcccagctacttgagaggctgaggcacaaaaatcacttgaacccaggaggcagaggttgtagtgagccaagatcgcatcactgcattccagcctgggtgacagagtgagactctgtctcaaaaaaacaaaaacaagtaaccctatattgatgccttgatgacttcattcacatctaggataaaggaaaccaaattaggttaattttaatatacttgaaagaatgacatatttactggtattggtgttatttattgtattgaataactttctatcaggcacatcataggctctgcatctaaaattggcctaggccaggcacagtgggtcacgcctataatcccaatgctttgggaggccaaggtaggtggattgcttgagcccaggagttcaagaccagcctggacaacatagcaagacgctgtccctataaataaataagaataaaactggcttggactaacgcgaggtgattttttacctttttttccagcctcaaaagctttctatgattattatgtaaaaataccaaaattacttgttccaaagaagatgattttttttattttttgagacagcgtcttgctctgttgctcaagctgtactgcagtggcatgatcataactcactgcagcttcaacctccatgggctcaagtgatcttcccacctcagcacctcagcctcctgagtagctaggaccacaggtgagggccatcaggctgggctaatttatattttctgtggagacggggtttgccatgttggccagcctggtctcgaactcctgagctcaagcagtttgcctacctcagtctctcaaagtgccaagattacaggtgtgagccaccatgcctggccccaaagaagattattttagagcactccaaacctttcctttagagcaaaataattcaattaacaggtagtactttaagacagaaactgggcttaacctccagcatgtgaaaagggagaaccactccacttaatgctaacacatgattacgttgggaaaagtacctgtcaagaacctaataaaatatcataaggtttgtccggacatggtggctcacgcctgtaatcccagcactttgggaggccaaggcaggtagatcacttgaggtcaggagtttgaaaccagcctggccaacctggtgaaaccctgtctctactaaaaatacaaaagttagctgggtgtggtggtgggcacctgtaatcccagctactcaggaggctgaggtgggagaatcacttgaaccctggaagcagagattgcagtgagtcgagatcatgccactgcactccagcctgggcaacagagtaagagtccatctcaaaaataaaataaaaataaaaaatgaataaaattgcttctttgtcctttggcaggcaaaatagcttttttatttttttatttttattttttgacacagggtctcgccctgtcacccaggctggagtgcagtgtcatgatctcagctcactgcagtctccacgtcctggacttaagcgaccttcccacctcagccgcccgagtagctaggactacagatgcataccaccacacctggctacttctgtttattgtttgtagacacaggatctcactattttgtccaggctggtcttgaactcctgaacccaacggatcctcccacctcagcatcccaaagtgctgggattacaggtgtgagccactgtacccagcccaagagagcttcttaattatggaatttcttcactgtccatgtcagttgatggtgaaatgtttattttttattcattagcagtggtccttgttccacctgcatttagctgtggtagcaccatggcttattaggaggtcaccaacttctggtgggagatacgcagtctctagtcttctgagacatagaagttctgactgcaattgactatgaagcaggactggtcctctgaatgttaacatgcatcttgaagacttcttagagtgaccctgggatgatgatggaggtagtaagaatattctcagatggggcttgactcactcatttggaatattaaaggtgaagttacctgggacaaactcagtgactttatgaggaaacaatcagagaaatacataatagcggacaagaacctttctagccttggtttcctcaaaaagttaaatttagggggaaggccaggcacggtggctcacacctgtaatcataacactttgggaggccaaggtaggcagatcacttgaggtcaggagttcgaaactaggctggccaacatggtgaaactccatctctactaaaaatattttaaaacgttagcccagcgtggtggcaggcacctgtaatcccagctacttgggcggctcagtcaggagaatttacttgggaggctcagtcaggagaatcacttgaacccagaggcaaaggttgcagtgagctgagatcacgccattgcactcaaccctgggcaacatgagcaaaactccatatcaaaaaaaaattaaaattgaaaaattagggggttaaaaaaaagagggggactgttctagattaaaagagactaaagaaacatgaaattcaaatgcagtgcatgaaccttaggtagaatcctggttccaattttattttttaagagatgggggtctcactctgtcacccagcctggagtgcagtggcaccatcacagcccactgcagcctcaaactcctgggctcaaaagatcctctggccttggcctcctaaaaggttgggattacaggtgtgagtcaccacgcccagccccttggttccaatttttttaagctataaataatattttgtaaagaatcagaaatttaatatggactggatattagatagtattaggagattactgggttttttagatgtggtaatagtaatattaagaacatcctggctgggcatggtggcttatgcctgtaatcccagccctttgggaggctaaggcgggaggattgcttgagcccaggagtctgagactagcctgggcaacatgacgaaaccctatctctaccaaaaattagccaggcaagatggcacacagctgtgatcccagctactcgggaagctgtggtgggaggattgcttgagtccaggaggtcaaggctgcagtgagctatgattgcaccactgcactccagtctgggcaacagagcaagaccttgtctcaaaaaacaaaaaaacaaacaaacaaaacaaaaaaacaaagaaagaatgtccctatttttatgagatgtgtaccagaataattaaggacagagtgtaatgaggtctgcaaatggttcacacaaaaaattaatactgtatatatccatgtccataaagaaagagaaaatatggcaaaatgtttgcaattgttaaatcgaggagctattatttatacttttatttaaactttgaaattttctttctttttttttttttttttttgatatggcgtctcgctctcttgcccaggttggactgcagtggcgtgatctcagctcactgcaacctccacctctgaggttcaagtgactctcatgcctcagcctccccagtagctaggattacaggtgtgcaccatcacgtctggctaatttttgtatttttagtagagatggggtttcactatgtgtgatccacccactttgacctcccaaagtgctgggattacagatgagagccaccacgtccggctaaactttgaaattttcatagcaaaatgttgtaaggtgggatgagatgtgccctttatatttcaaactaagaaagcaggatatttcagtaatttatttattcataaagatcttttgaatgcctgccatgtgctaggcactgtaataaggtctgggtgtaccttggtgattaaaacagtaatgttctcttttataaatgttatgctgcattacccaatctctcctttaagactgaaggatttattcccccagcttttgggaagcttgtatgctgacagccttcttcagtgactgtcttgctaaagaaagctgccttattcaaggtccagtcaccttataggggcagcctgcaacaaatgactagtcgcgccaggcctaatctttaatttcaatgcaattaccattttttcttgttttcaaaacttaacaaaattattctaatgtttatatgtgagaagagccaggaaataccaaaaaagaattctagaaaagaagagtgatggctatgaagagacagagtaggagcaatttactaatccatcatagtgatttcaagagttgagtattgactgctgccttctaagaacttaaaaggccctctccgctctcccctctcccctctcccctctcccctctccccacggtctccctctcatgcggagccggagctggactgtactgctgccatctcggctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccatcgtctgggctgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccggaagggaggtggggggggtcagccccccgcccggccagccgccccatctgggagggaggtggggggtcagcccccccgcccggccagccgtgccgtccgggagggaggtgggggggtc

SEQ ID NO: 2 - DNA, 574 bp, Homo sapiens
tcatggcccaggcgtcgccgccccggcccgagagggtgctcggcgccagcagcccggaggcccggcccgcgcaggaggcgctcctccttcccaccggtgcaccacaaccgatgtcaactctcctagcgcccctccgctcaccggtaaaccaggacagtggaggggcgccctgatgcggtgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggaggtgtctttcaggttgcagaaaagatggaaaaaaggacatgtgcactctgccccaaagatgtcgaatataatgtcctatactttgcacaatcagagaatatagctgctcatgagaattgtttagctgtattcttcaggacttgtggaatgtgaggatcaggatccacttaatcctgatagaagttttgatgtggaatcagtaaagaaagaaatccagagaggaaggaagt

SEQ ID NO: 3 - DNA, 306 bp, Homo sapiens
caccacaaccgatgtcaactctcctagcgcccctccgctcaccggtaaaccaggacagtggaggggcgccctgatgcggtgtctttcaggttgcagaaaagatggaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 4 - DNA, 307 bp, Homo sapiens
caccacaaccgatgtcaactctcctagcgcccctccgctcaccggtaaaccaggacagtggaggggcgccctgatgcggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 5 - DNA, 273 bp, Homo sapiens
caccacaaccgatgtcaactctcctagcgcccctccgctcaccggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 6 - DNA, 296 bp, Homo sapiens
caccacaaccgatgtcaactctcctagcgcccctccgctcaccggtaaaccaggacagtggaggggcgccctgatgcggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 7 - DNA, 262 bp, Homo sapiens
caccacaaccgatgtcaactctcctagcgcccctccgctcaccggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 8 - DNA, 469 bp, Homo sapiens
caccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 9 - DNA, 435 bp, Homo sapiens
caccacaaccgatgtcaactctcctagcgcccctccgctcaccgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaaggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 10 - DNA, 347 bp, Homo sapiens
caccacaaccgatgtcaactctcctagcgcccctccgctcaccggtaaaccaggacagtggaggggcgccctgatgcgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaagctgtattcttcaggacttgtggaatgtgaggatcaggatccacttaatcctgatagaagttttgatgtggaatcagtaaagaaagaaatccagagaggaaggaagtt

SEQ ID NO: 11 - DNA, 313 bp, Homo sapiens
caccacaaccgatgtcaactctcctagcgcccctccgctcaccgggcaagactcagccaaaggtggaaaagttgaaggggtgttcccagcagagaggatgacacaaaggcaccaaaccacaaaacgtcacacgtaaacatcatacgtggcaaccacaagccaatcagttggatatttcattcattggtatacatatggactgtaagctgtattcttcaggacttgtggaatgtgaggatcaggatccacttaatcctgatagaagttttgatgtggaatcagtaaagaaagaaatccagagaggaaggaagtt

SEQ ID NO: 12 - DNA, 185 bp, Homo sapiens
caccacaaccgatgtcaactctcctagcgcccctccgctcaccggtaaaccaggacagtggaggggcgccctgatgcgctgtattcttcaggacttgtggaatgtgaggatcaggatccacttaatcctgatagaagttttgatgtggaatcagtaaagaaagaaatccagagaggaaggaagtt

SEQ ID NO: 13 - DNA, 151 bp, Homo sapiens
caccacaaccgatgtcaactctcctagcgcccctccgctcaccgctgtattcttcaggacttgtggaatgtgaggatcaggatccacttaatcctgatagaagttttgatgtggaatcagtaaagaaagaaatccagagaggaaggaagtt

SEQ ID NO: 14 - DNA, 202 bp, Homo sapiens
tcatggcccaggcgtcgccgccccggtccgagagggtgctcggcgccagcagcccggaggcccggtccgcgcaggaggcgctcctccttccaccgctgtattcttcaggacttgtggaatgtgaggatcaggatccacttaatcctgatagaagttttgatgtggaatcagtaaagaaagaaatccagagaggaaggaagtt

SEQ ID NO: 15 - DNA, 325 bp, Homo sapiens
tcatggcccaggcgtcgccgccccggcccgagagggtgctcggcgccagcagcccggaggcccggcccgtgcaggaggcgctcctccttcccaccggtgtctttcaggttgcagaaaagatggaaaaaaggacatgtgcactctgccccaaagatgtcgaatataatgtcctatactttgcacaatcagagaatatagctgctcatgagaattgtttgctgtattcttcaggacttgtggaatgtgaggatcaggatccacttaatcctgatagaagttttgatgtggaatcagtaaagaaagaaatccagagaggaaggaagtt

SEQ ID NO: 16 - DNA, 290 bp, Homo sapiens
  misc_feature (268)..(268): n is uncertain
tatggcccaggcgtcgccgccccggcccggcccgcgcaggaggcgctcctccttcccaccggtgtctttcaggttgcagaaaagatggaaaaaaggacatgtgcactctgccccaaagatgtcgaatataatgtcctgtactttgcacaatcagagaatatagctgctcatgagaattgtttgctgtattcttcaggacttgtggaatgtgaggatcaggatccacttaatcctgatagaagttttgatgtggaatcagtaaagaaanaaatccagagaggaaggaagtt

SEQ ID NO: 17 - DNA, 126 bp, Homo sapiens
atccggccgccacccgcagctgcagcacagtcatggcccaggcgtcgccgccccggcccgagagggtgctcggcgccagcagcccggaggcccggcccgcgcaggaggcgctcctccttcccaccg

SEQ ID NO: 18 - DNA, 122 bp, Homo sapiens
gtgtctttcaggttgcagaaaagatggaaaaaaggacatgtgcactctgccccaaagatgtcgaatataatgtcctgtactttgcacaatcagagaatatagctgctcatgagaattgtttg

SEQ ID NO: 19 - DNA, 108 bp, Homo sapiens
ctgtattcttcaggacttgtggaatgtgaggatcaggatccacttaatcctgatagaagttttgatgtggaatcagtaaagaaagaaatccagagaggaaggaagttg

SEQ ID NO: 20 - DNA, 134 bp, Homo sapiens
aaatgcaaattttgtcataaaagaggagccaccgtgggatgtgatttaaaaaactgtaacaagaattaccactttttctgtgccaagaaggacgacgcagttccacagtctgatggagttcgaggaatttataa

SEQ ID NO: 21 - DNA, 47 bp, Homo sapiens
actgctttgccagcaacatgctcaattcccgatcatcgctcaaagtg

SEQ ID NO: 22 - DNA, 65 bp, Homo sapiens
ctaaattttcaggagtgaaaagaaaaagaggaaggaagaaacccctctcaggcaatcatgtacag

SEQ ID NO: 23 - DNA, 67 bp, Homo sapiens
ccacccgaaacaatgaaatgtaatacattcataagacaagtgaaagaagagcatggcagacacacag

SEQ ID NO: 24 - DNA, 133 bp, Homo sapiens
atgcaactgtgaaagttccttttcttaagaaatgcaagggaagcaggacttcttaattacttacttgaagaaatattagacaaagttcattcaattccagaaaaactcatggatgagactacttcagaatcag

SEQ ID NO: 25 - DNA, 72 bp, Homo sapiens
actatgaagaaatcgggagtgcactttttgactgtagattgttcgaagacacatttgtaaattttcaagcag

SEQ ID NO: 26 - DNA, 469 bp, Homo sapiens
caatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccatttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagatataataaatttggattatactaaaa

SEQ ID NO: 27 - protein, 331 aa, Homo sapiens
MAQASPPRPERVLGASSPEARPAQEALLLPTGVFQVAEKMEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 28 - DNA, 105 bp, Homo sapiens
cacaaaggcaccaaaccacaaaacgtcacacgtaaacatcatacgtggcaaccacaagccaatcagttggatatttcattcattggtatacatatggactgtaag

SEQ ID NO: 29 - DNA, 122 bp, Homo sapiens; identical to SEQ ID NO: 18

SEQ ID NO: 30 - DNA, 108 bp, Homo sapiens; identical to SEQ ID NO: 19

SEQ ID NO: 31 - DNA, 134 bp, Homo sapiens; identical to SEQ ID NO: 20

SEQ ID NO: 32 - DNA, 47 bp, Homo sapiens; identical to SEQ ID NO: 21

SEQ ID NO: 33 - DNA, 65 bp, Homo sapiens; identical to SEQ ID NO: 22

SEQ ID NO: 34 - DNA, 67 bp, Homo sapiens; identical to SEQ ID NO: 23

SEQ ID NO: 35 - DNA, 132 bp, Homo sapiens
atgcaactgtgaaagttccttttcttaagaaatgcaaggaagcaggacttcttaattacttacttgaagaaatattagacaaagttcattcaattccagaaaaactcatggatgagactacttcagaatcag

SEQ ID NO: 36 - DNA, 72 bp, Homo sapiens; identical to SEQ ID NO: 25

SEQ ID NO: 37 - DNA, 469 bp, Homo sapiens; identical to SEQ ID NO: 26

SEQ ID NO: 38 - protein, 292 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 39 - protein, 191 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKGSRTS

SEQ ID NO: 40 - DNA, 114 bp, Homo sapiens
ctcctcctcttcgctgccggtgggcaccgccgctcgctcgcacttctgcgcccattggagcttcggagatccctgcggtcccgcgggacggcgcggcagcagctgacctcgcag

SEQ ID NO: 41 - DNA, 80 bp, Homo sapiens
acaggatcttgctctcttgcccagactggaatacagtggtgtgaacacggctcactgcagcctcaacctcctggactcag

SEQ ID NO: 42 - DNA, 167 bp, Homo sapiens
agatgtcggcttatttataggaattgcttgaagccagagtcatggtggatgtcggaaagtggcccatcttcactctactctcccctcaagagatcgcgtctattcggaaggtgtgtgtcttcggcacctcagccagtgaagcactgtacgttactgacaatgatgag

SEQ ID NO: 43 - DNA, 151 bp, Homo sapiens
gtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaag

SEQ ID NO: 44 - DNA, 167 bp, Homo sapiens
atggagtggtttatgcctggggccacaatggatatagccagcttgggaatgggacgaccaaccaaggcatcgctcccgtccaggtctgtaccaatctcttgatcaagcaagtggtggaagtagcttgtggctcacatcattcaatggctctggcagctgatggagag

SEQ ID NO: 45 - DNA, 159 bp, Homo sapiens
gtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgag

SEQ ID NO: 46 - DNA, 108 bp, Homo sapiens
gtatatggctggggttacaatggcaacggtcagctgggcttgggaaacaatggcaaccagctgacccctgtgagagtggcagctttgcacagcgtgtgtgtgaaccag

SEQ ID NO: 47 - DNA, 143 bp, Homo sapiens
attgtctgcggttacgcacatactctagcactaacagatgagggcttgctgtatgcctggggagctaacacatatgggcagctgggaactggcaataaaaataacctgctaagcccagcacacatcatggtggagaaagaaag

SEQ ID NO: 48 - DNA, 191 bp, Homo sapiens
ggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactccggccgtctcgtggcgcctcctgtctgtgg

SEQ ID NO: 49 - DNA, 127 bp, Homo sapiens
agcatgaagactttttaacagttgcagagtcactgaagaaagaatttgatagtccagaaactgctgatctgaagtttcgaattgatggaaaatatattcatgtccataaagctgttttgaaaatcag

SEQ ID NO: 50 - DNA, 152 bp, Homo sapiens
gtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctatag

SEQ ID NO: 51 - DNA, 131 bp, Homo sapiens
gtcttctggatttggcgacatcttactgtgaaaacagactgaaaaaactttgtcagcacattatcaagagaggaattactgtggagaatgccttttcgctattctctgctgcagtcagatatgatgcagag

SEQ ID NO: 52 - DNA, 2330 bp, Homo sapiens
gatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccacgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtgggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaatatttaaaaaaaaaaa

SEQ ID NO: 53 - protein, 531 aa, Homo sapiens
MVDVGKWPIFTLLSPQEIASIRKVCVFGTSASEALYVTDNDEVFVFGLNYSNCLGTGDNQSTLVPKKLEGLCGKKIKSLSYGSGPHVLLSTEDGVVYAWGHNGYSQLGNGTTNQGIAPVQVCTNLLIKQVVEVACGSHHSMALAADGEVFAWGYNNCGQVGSGSTANQPTPRKVTNCLHIKRVVGIACGQTSSMAVLDNGEVYGWGYNGNGQLGLGNNGNQLTPVRVAALHSVCVNQIVCGYAHTLALTDEGLLYAWGANTYGQLGTGNKNNLLSPAHIMVEKERVVEIAACHSAHTSAAKTQGGHVYMWGQCRGQSVILPHLTHFSCTDDVFACFATPAVSWRLLSVEHEDFLTVAESLKKEFDSPETADLKFRIDGKYIHVHKAVLKIRCEHFRSMFQSYWNEDMKEVIEIDQFSYPVYRAFLQYLYTDTVDLPPEDAIGLLDLATSYCENRLKKLCQHIIKRGITVENAFSLFSAAVRYDAEDLEEFCFKFCINHLTEVTQTAAFWQMDGPLLKEFIAKASKCGAFKN

SEQ ID NO: 54 - DNA, 484 bp, Homo sapiens
cctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacag

SEQ ID NO: 55 - DNA, 386 bp, Homo sapiens
tgcactattctttattgttttccttacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatg

SEQ ID NO: 56 - DNA, 126 bp, Homo sapiens
gcgatgcaaaaactttctggatggagctagaagatgatggaaaagtggacttcatttttgaacaagtacaaaatgtgctgcagtcactgaaacaaaagatcaaagatgggtctgccaccaataaag

SEQ ID NO: 57 - DNA, 66 bp, Homo sapiens
aatacatccaagcaatgattctagtgaatgaagcaactataattaacagttcaacatcaataaagg

SEQ ID NO: 58 - DNA, 36 bp, Homo sapiens
gagcatcacagaaagaagtgaatgcccaaagcagtg

SEQ ID NO: 59 - DNA, 97 bp, Homo sapiens
atcctatgcctgtgactcagaaggaacaggaaaacaaatccaatgcatttccctctacatcatgtgaaaactcctttccagaagactgtacatttct

SEQ ID NO: 60 - DNA, 564 bp, Homo sapiens
aacaacaggaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacat

SEQ ID NO: 61 - DNA, 117 bp, Homo sapiens
aacaaaatgtgcatgtcttcaactgacagcaaggaatgccaaaacttcccccttgtcaagtgacaaaataaccactggatataaatataaaagactacagagacagattcctactgg

SEQ ID NO: 62 - DNA, 170 bp, Homo sapiens
catttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcag

SEQ ID NO: 63 - DNA, 224 bp, Homo sapiens
gaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttact

SEQ ID NO: 64 - DNA, 100 bp, Homo sapiens
ggaaacgaaatatgataatatttcaagaattcaatatcattcagttattagagatcctgaatccaagacagccatttttcaacacaatgggaaaaaaatg

SEQ ID NO: 65 - DNA, 94 bp, Homo sapiens
gaatttgtttcctcggagtctgtcactccagaagataatgatggatttaaaccaccccgagagcatctgaactctaaaaccaagggagcacaaa

SEQ ID NO: 66 - DNA, 341 bp, Homo sapiens
aggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaat

SEQ ID NO: 67 - DNA, 89 bp, Homo sapiens
catagttgttgcccaaatctcttggtacagaatgtttttgtagaaacacacaacaggaattttccattggtggcattcttcaccaacag

SEQ ID NO: 68 - DNA, 431 bp, Homo sapiens
gtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtca

SEQ ID NO: 69 - protein, 719 aa, Homo sapiens
MGEKNGDAKTFWMELEDDGKVDFIFEQVQNVLQSLKQKIKDGSATNKEYIQAMILVNEATIINSSTSIKGASQKEVNAQSSDPMPVTQKEQENKSNAFPSTSCENSFPEDCTFLTTGNKEILSLEDKVVDFREKDSSSNLSYQSHDCSGACLMKMPLNLKGENPLQLPIKCHFQRRHAKTNSHSSALHVSYKTPCGRSLRNVEEVFRYLLETECNFLFTDNFSFNTYVQLARNYPKQKEVVSDVDISNGVESVPISFCNEIDSRKLPQFKYRKTVWPRAYNLTNFSSMFTDSCDCSEGCIDITKCACLQLTARNAKTSPLSSDKITTGYKYKRLQRQIPTGIYECSLLCKCNRQLCQNRVVQHGPQVRLQVFKTEQKGWGVRCLDDIDRGTFVCIYSGRLLSRANTEKSYGIDENGRDENTMKNIFSKKRKLEVACSDCEVEVLPLGLETHPRTAKTEKCPPKFSNNPKELTMETKYDNISRIQYHSVIRDPESKTAIFQHNGKKMEFVSSESVTPEDNDGFKPPREHLNSKTKGAQKDSSSNHVDEFEDNLLIESDVIDITKYREETPPRSRCNQATTLDNQNIKKAIEVQIQKPQEGRSTACQRQQVFCDEELLSETKNTSSDSLTKFNKGNVFLLDATKEGNVGRFLNHSCCPNLLVQNVFVETHNRNFPLVAFFTNRYVKARTELTWDYGYEAGTVPEKEIFCQCGVNKCRKKIL

SEQ ID NO: 70 - DNA, 2012 bp, Homo sapiens
atcctttccccctaccaatggggtaatcagaaagtggtcaatactaaatccaaatgaagtcctttaattgcaccatcagaagcagaaagggtgatttgagaataacccagtgtattccgtggctacataaaaaagatgatttgagaataacccagtgtattccgtggatacataaaaaagatgatttgagaataatccagtgtattccgtggatacatttgtagtgaagtttggtggcttgcttagaatcccagctcagcgtggccacccggtttgtgaagcgctgagctccttggctcaggacacgctccttcacctcagacccactcatgtctgtttcttctgcgcctttttctccgtcccatagacggtggcatttctcagggctttgtcttcaacccccttcccttgccactcaacctgcctccctggggccctcacccaggcatgtggtttctgcttcttccagcgctgacagtgcccttcctgggagtgctggctgtgggcagagcctgtgcgcccgtgcgtttgtgcctcgcctgtttggtcctcaggcagtgtggcgggcagggcatgaaacagcccctggtatgcaagtggagacagaggctgggagagagccggtgccctgcctaaactcacgcaagcaggaagaggtaagaccaggatttgaacccgggagggcgagatgccatgtctgagctctttttggagttttgtcttcctggatgttctgcacaggcacagcccgtgtggggagaaccccgccctagacccctccctgacttccctcccaacgcccacttccctcttggactcaaccaccagcgtctccacatgcatccaatcaccgtgaccaaaactccatttctccttctcccctgcagaccgagcaccctctgggccctgttctgtttccccccaaggtactcctgtcatctgtggatttttctgtttttttgataaagcattctgaaataaatcaaagccaccatagaatttcagataccatcatcacacttttcaatacgaacaataattcatctaatactctgcttcacattcctccaattatcctagaaatactgtttttcctgttcatttgctctgtttttctggaatggctttttgtgcccctgtgactatttgagtctgtgacaccaggtgaccccaccctaatgtgtgctaagaatttgatgtagaaaataaaataatattcaaagcaaagggatataaccttatgccagtggttctcaattggggacaattttgtctctggggatacttggcaatgtctggagacatcttacattgtcacggtgcaagggagctcctggtatttaattgtagaggctgtgaggtgctgccaaacgtgccacaaagtacagggcaggcctcgcaaagactcatccagcccacgatgtcaattgtgcagaggctgggaaactggcctagaagtgtcacaggacactggccacaagcccacacaaaggaggacctctctctacttttgttgtttctactgtttgttgaacatttactaaatgccagtcagtatcctacacactctggatacaacacctcatttaatcccaaaacaactctgagagccatgtattccataccattacccccattttatagatgagaaaattggagcccagagagggtaagcccatcgtccagggtcaccaagctcaggacaagagattacaacactggcctctgaaaagactcactaccaccttaggagcaagtgttagaggaaggcgaggaggagggtgaggaagaacacgagctgactgcaggaggcgtcaggctgagctcctgcctggaggggggcactgcagcctgggcagcagcaggagctggtgctgtgtgtgtatgagtgtgtgtgtgattgtgtgtgattttgtgattgtgtgtgattttgtgattgtgtgtgtctgtgtgtatatgtgtgattgtgggtaccgagccgaattcgtaatacagtgatattttccccccag

SEQ ID NO: 71 - DNA, 379652 bp, Homo sapiens
gaccctctgcctggcaaccaccccgtttgagaagtgaggagcccctccgcccgacatttgccccgtttaaaaagtgagaagcctctcctctcgcccgcccccccttttgggaagtgaggagcctttctgcccggccacccccccgttcggaaaggaagttgggggggtcagcccccccacccggccagccgccccgtccgggagggaggtgggggggtcagccccccgcctggccagccgccccatccaggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgaccggccagccgccccatccgggagggaggtgggggtgtcagccccccgcccggccagccgccccatccgggagggaggtgggggggtcagccctccgcccggccagccgccccgtctgggaggtgaggggcgcctctgcccggccgcccctactgggaagtgaggagcccctctgcccggccaccaccccgtctgggaggtgtgcccagcagctcattgagaacgggccaggatgacaatggcggctttgtggaatggaaaggcaggagaggtggggagaggattgagaaatcggatggttgccgtgtctgtgtagatagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacattgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaatgactagtcaatgtcagaatgttaagacctgatccacggtggttcatgcctgtaatcccagcactttgggaggccaaagctggtgatcacttgaggccaagagttcaagaccagcctggccaacatggtgaaagcccatctctactaaaaatatgaaaaattagctgggtgtggtggctggtgcctgtaatcccagctacttgggaggctgaggcaggagaatcgcttgaacccaggaggcagaggttgcagtgagccaagactgcaccactgcactccagcctgggccacagagcaagattccatctcaaaaaaaaaaaaaaaagaaaagaaaagaaaaaaaatacctgtccctttcacctcctcaggggacatctctgaagagtcatcccagctttagaactccccacagggttggctgagggctggttgtgactacactgcagcccactttctctttctgccagttttgcttccatccttttcctccacaggtcccaagagcatctaccattgaaaaggcattaaataaccaagtggaatgactcagccagttgatgtcagccagctttttcatcagccaccctagtcctggcacaatggattcatagaggagacatggaagcaaaggaggctatccatgggcccaactgcatgatgtcccacttaccattgttaatctagctactgtcacagccaaataatcaccctgacaccaacagaaactgttgctgaaactcagtacaacaatatcccttgaagataccaaccagccacttgatggcaagttgaccctattgaactctttccataatgaaaggagcagccattcattttcacaggaataggcaggtattctgtgtatgggtttgcctttcctgcctgcagtctcatcaaacatgaccatccaagggcttagctgcatttaatccaccaaggtggcattccacatatcattgcagcagaccaagggaccagctttacaacaaaggacatatagcattggtcacatgaccatggaatccactggacctatcatatggcacaccacccaagctactggcctaataagcaatggaacagcctgttgaaagcttggctaaagtgccagcttggaaatgataccctgtgaggataaagcttggaatgcttttatactgttggtgggagtgtaagttagtttgaccactgtggaagacagtgtggtgattcctcaaagatctagaaccagaaataccatttgacccagcaatcccattactgggtatatacccaaaagattataaatcattctactgtaaagacacatgcacacatatgtttactgcagcactatttacaatagcaaggacttggaaccaacccaaatgtccatcaatgatagactggataaagaaaatgtggcacatacacaccatggaatactatgcagccataaaaaagcatgggatcatgtcctttgcagggtcatggatgaaactggaagccatcattctcagcaaactagcacaggaacagaaaaccaaatatcacagttctcactcataagtgggagtcgaacaatgagaacacatggacacagggaggggaacatcacacaccagggcctgtcggggggtggggggcaaggggagggagagcattaggacaaatacctaatacatgtggggcttaaaacctagatgacaggttgatggctgcagcaaaccaccatggcacatgtttacctatgtcacaaacctgcacattctgcacatgtattccagaacttaaaatttaaaaaaaattttttttaaaaagcactaccctccaggatgcagtaatgcctgaagtcagtcaccattatatagtgcagtatccccaagagaatacctgggagatgaatccatggtgtgggagcagcagtgtccccacttgctatcagtcccagtgacccagttaaagaatttatgttttcatcctcacaaatgtagcccacagggtcgaaggtcttggtttccaacagggaaacatttccaccagggaacacagcaagagtcttcattgaactttaagctacctcatcatgcaggcactttgggcctttcatgccaagggccagcaggcaaggaaaggatcccagttggggtgattgactcttatcatcaagaagcagtccagctgttgttacacaatggaggcaggaagcatatgtttgatacccagatcattgacttggacatctgttagtaccagcttggccaattttgatggcaaatggacaagtgcagcagctacaccctgagaaggtacggcaaatgggacagaatgcctcagttttgagagtctgagtcacctcactagaaaagtcacctaaaccttcacagggacttgtcgagcagagggtggggggatgaatatcagctatagcctcaagaccagctgcagctgcagggaggctgtagttcatcctaccaaccctccttttacaagtcatccccaggaagagaggcccaccagtgtcccaaaggagccactcccagaattcttgtaaagaaagtagatctgagtgacacttgctgtattaggctgttctcacattgctataaagaaatatctgagacttgctaatttataaagaaaagaggttttgttggttcacggttctgcaggctttacaggaagcatagcgctgtttttccgttatggtggaaggtgaaggggaaacaggcaagtcacatggtgaaagcaggaggaagtgaagggaatggggtagatgccacacacttttaaaactgccagatctcatgtgaactcagagcaagagctcacttatcaccaagaggatggcgcaagccattcatgaaggacccaccgcaccctcccccgtgatcccaacacctctcaccaggctccaccttccaacattggggattacatttcaacctgagatttgggtggggacaaatatccctatgctatcacgtgctgtggactgccttgcctgggttgtagctgtcatccctctggggatggcttcagctgaagagagctgcctcagcgtaaggcctgtgccgaacagctagtgtacggcgactgagtgatgcccaatcctatttccttttgttcaatgggtgttgattagagtgccccctcgtaaacttcctatgtgctaatctccatctcgcagttggcttccggggaacatcttatctgtgacagtctgtccagtgtagattacagtttgcagaagacagcaaacaagcaaagtagatttgtgatttgtacactgaaggaaatgaacaagatgcaatgatagcagataacagggaggtgtacctggaagaggtgacacttaagccaagaactataaacagatagatgccagccatgtgaaaagcaggtaggagagtgtgtcccagaaagagaaacagttctgataaaagccgatcgcaaagagtcaggcatgtttaagtaccacccagagctttgtaatctttttaaaagtttttctgtggccaggcgcggtggctcacacctgtaatcccagcgccttgggaggtcaaggcgagtagatcacctgaggtcaggagtttgagaccaacatggcaaaaccctgtctctactaaaaatttaaaaattagccgggcatgatggcgcatgcctgtaattccagctactcagaagtctgaggcacgagaattacctgaacctgggaggtggaggttggagtgagccgagatcacgcaactgcactccagtggtgtgatcacatctcactgccgctttgacctccccaggttcaggcgatctcccacctcagcctcccaagtaactgggactacaggcatatgccaccatgccccactagttttttttgtagagacggtttcaccatattgtccaggttggtctcaaacttctgggctcaagcaatccatccaccctggcctcccaaagtgctaggattacagatgtgagccaccatgcatagcctaaaaggttttatttcaaatgcaatggaaagccttcaaaaggttttaagacaagagagtaacatgctatgatttacatttttaaaaaattctgtctggatactgtgtggaaaacagattggatggggggaaccattaagaaggttatttgcagggtggggtgtggtggttcacacctgtaatcccagcactttcggaggccaaggtgggtggatcacgagatcaggagatcgagaccatcctgaccaacatggtgaaaccctgtctctactaaaaatacaaaaatcagccaggcgtggttgtgtgtgcctatagtcccagctattcaggaggctgaggcaggaggctcacttgaatccaggaggtggaggttgcagtgagccaagattgtgccactgcactccagcctgggcgacagagcaggactccatctcgaaaaagaaatagaaattaaaataaaataaaaatgttattgcagtatcaaggaaagatgcccacccaaagtctgtcccttcgcactaaaccatagtccaaatgcccaagaccttggaattccatgcccagacaactccaacccacttccaagatttgcatgggcctcttccctaggtccttctcctcaacagcagactccacacacctagagccatggggtggcctgtctgtttgtggggaatgtggacagagtttggaagagaagtatccacaagcatgtgggtgaagccccttgcagtgccagatgaagccaagattggaatggagggagatgaggtgaggggaaaggggccagggtggtaattgtggggaaaagcaagagagatcagattgttactgtgtctgtgtagaaagaagtagacataggagactccattttgttctgtactaagacaaattcttctgccttgagattctgttaatctatgaccttactcccaaccctgtgctctctgaaacatgtgctgtgtcaaactcagggttaaatggattaagggcggtgcaagatgtgctttgttaaacagatgcttgaaggcagcatgctcgttaagagtcatcaccactccctaatctcaagtatccagggacacaaacactgcggaaggccacagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtacgttctatctactgagatagggaaaaaccgccttagggctggaggtgggacatgcgggcagcaatactgctttgtaaagcattgagatgtttatgtgtatgcatatctaaaagtacagcacttaatcctttaccttgtctatgttgcaaagacctttgttcacgtgtttgtctgctgaccctctccccacaattgtcttgtgaccctgacacgtccccctcttagagaaacacccacgaatgatcaataaatactaagggaactcagaggctggcgggatcctccatatgctgaacgctggtcccccgggtccccttatttctttctctatactttgtctctgtgtctttttcttttccaagtctctcgttccaccttacgagaaacacccgcaggtgtggaggggcaacccaccccttcagtaatcactccctacactgccaagttccaatatggaacccctaggatttctaaattcaaggtatggccatccaagtcactaaaaagctgtatctgtcaagataggaggataggctgggtgtggtaactcacacgtgtaattccgatgctctgggaggctgaggctggaggatcatttgagcccaggagtttaagaccagcctgagttacatagcgagacccccatctctaagagaataaaaaatataattcgccaggtgtagtggtgcatgcctgtggtcccagctactcaggaggctgaggcaagaggattgcttgagcctgggaagttgaggctgcagtgaactgtgattgtgccactgcactccaacctgatggatgacagaatgagactgtgtcttaaaaaaaaaaaaaaaggaggatagaacatattttatttaacaagttattcgcttgatttctgacttaaaaatttttagacatatggtatcccccatttgtaattttgcactgggtgctacggatgttcaggatagccccgaaagtcacgtcatctataaagaaacaacaagagaccgaaagctggtttcttatttcaaacagtagataatgcacagaggataatgcagtatcttcaaaatgaaagggaaaatttctgtcggtttagaattccctgtctagttaaactggtattcaaaagtgaggataaaataaagacattatcaaaccaagactaagagaatttcccactcacagacccttgctgaaagaagtcctgaaagatgtagtttatttatttattttgagacagagtcttgctctgtcacccaggctgaagtgcagtggtgcagtcttggcttactgcaacctccgcctcctgggttcaagcaattcttctgcctcagcctccagagtagctgcgactatgtatgcaccaccgtgcctggctaattttttcgtatttttagtagggacggggtttcaccatgttggccaggctggtcttgaactcctgacctcaagtgatctgcccgcctcggcctcccaaagtgctaggattataggcatgagccaccacgcctggccaggatgtagtttagaaagaggaaaaataaacccagcagaaaggatcagtatgtgaggcttaatgatgagcaaagaaattactgatttttagaggataagcacagagtggaactagactagtacctagcaatcaagtgaaaggtgagaggcaagattcacagttaaaacagtctaagatctttatgatgtaaggtatacaatttaaactttttcagctataactttttagtttttttttatctcagaaaaaaatatggaatgcttcacgaattttttatttttttgtgtgtggagatgacggggtctcactatgttcaccaggctggtcttgaactgctggcctcaagcaatccttctgccttggcctcccaaagtgctaggactacagatgtgagccaccttactgggtctcagctataaattttaatatttttaaagtaactatgttaagcaaatatgcaaaaagaaagaaaaaaagtgaatagttaggatgaaagaccccttcccccagaaaagcaaaacaagtttagttgttagtacatataaaatagtcctcatttcaatatgagaaaaggcactgattttttttttttttttttgagacggagtcttgctctgtcgcccaggctggagtgcagtggcataatctcggctcactgcaagctctgcctcccgggttcacaccattctcctgtctcagcctcccgatagctgggactacaggtgcccgccaccatgcccggctaattttttgtacttttagtagagacgggggttcaccatgttagccaggatggtcttgatcccctgacctcgtgaactgcccgcctcggactcccaaagtgctgggattacaggtgtgagccaccgcacccggcctactaatttattttttgtaaaactcctctaacccaaaccactggctataaaatactaccacctctgccatcattgtcccccaaatacaagttatttttcatctgtgaaggaagctttatgagagctattgcactttattcttataaaactccatgaaagatagacattaaaatgtttgcagaaatctcataaacttggcttttaaatgaatgagtcagtcatcaacagctatttgcacaaaactttactcttttctctgagcaatacaaagaaaacaggacagtccctcccatgaaggagcttaaaatctgatttggcagacgcaagctgtataaactcacctggaaataaaacctgggatagaagacagcaaatagtaaaaggctgcaattggtataacccttacatatcttggaaggctttgactcaatacatgaaatttgagctttaagagaggtagaatttcgttagagaaaactggggactggcataagcataaagcactaaaacagagaaaggtgttagagccaagacagaagatattttcaaaaaagaagggtagctgggtgtggtggcacatttctgtagtcttgtaactgcccagtgggttcgttttccttgctgcccagatagagctgatttatccagacaggggagtcatgatacagagtttaactcacacagagctggctgacaggagaccagagttttattattactcaaatcagtctcttcaaagatttagagactagggtttttcaaagacagtttggtgggtacagggccagtgagtcgggagtgctgattggttggatcagagatgaaatcatagggagtcaaagctgtcctgagctgaattggtttctgggtggggcccacaggactggttgatgagtccaggtggacccattgttcatcagaaatgcaaaaacccaggccgggcgcggtcactcacgcctgtaatcccagcactttgggaggccgatgtgggtggatcacaaggtcaggagatcatgaccatcctggccaacatggtgaaaccccgtttctactgaaaataaaaaaaaaaaattagccgggcatggcgacgtgcacctgtagacccagctactcaggaggctgagacaggagaatggcgtgaacccgggaggcggagcttgcagtgagctgagatcatgccactgcactccagcctgggcgacaaagcgagactccgtttcaaaaaaaaaaaaaaaaaaaaaaaaaaaaaaaggcaaaaacccgaaaagacatctcaaaaggccagtcttaggttctacaatagtgatgttatctgcaagaataattgaggaagttgctaatcttgtggcctccacaataatggttggtaatattttagctaagcctgtatcttaatagaatccaggcccctcccatcctcctaacttgaccttccattaggtttacaagggcagtttagttttgggggagggctattatcgtttaaactataaactaaatttgccccaaagttaccttggcccacatccaggaatgagtgaagacagccagcctgtgagactggaagcaagatggagtcagccatgtcagatttcttttactgttgtaattttgcaaaggcagtttcagcccgagctactcaggaggctgaggcttcacttgagtccaggaattcgggctgtagtgcactatcatggtggctgtgaatagctgctgtactccagcctgggcaatgtagcagacccagtctttaatttaaaaaaaaaaaaaaaaaggacatatcctaatctgtcatgggagtagagttaaaaaaaaaggggggggggtaatcattatgtgaaatactgagagaaatcatttaatgaatcataatatggactgaagtaaacacaaggatgaaataattgaaaatactgttttcaatatgacaccaacttcagtattttatctcatttcccttcttgtatatgccattaaattttcaaaaaatgtagcaaatataaatacaagatgttgactttctgtgagttacatatatgaatagcttacagttttactgcttctacatacaactttatttcctagactttctctagcttaaaaaaatcctgcagacaagatcaccattatattgcttgtgttttaagttcagggctgtaggcttctggtttgtaatactgagagaaacgctattaatagtattcctaaaggcataaagctttcctccaaaccatgactctcggaccaaggctcctttcattttgtggccctgccatcttcaacaagtggcttccagggtctttgcagaaggggaaagaacaaggaggaccaccgtgggagagctgcgtgtgagcttagcctggaaatagcacgcttctcttccttttgttacagtaggtagtaggcagacatgagcagggcaggaaagcacccccctaccacaaccaggaatgtcaggaaaccatcaggtaatggtcaggcggttgttaactgtctctctaaaataataattggttgcagccagcgccagagaaaggcaggctctcaataaatagaaaacacccgaaactggtgatcagcagcttcctggtaagatctcaggagttgggtgagtgggctcaagcatgaaaactaaggcaaaatggcagagtttaaccagtatatgaccttcctctagaacactcaactggtaagggaaaaacgcctcaagtgagcatgtgcacagcttcagtaaacacactgcacatgcggctcctcccaagtgctggcaggccagtgcgaatgcagacagcccaccccaaaggaagaactgggagaagagatgttacccactggaagcatgccagtgtataaagccccgagtcaaaggtcaaactgtacacttgaatctttcacgttacctgcttggccctcttccaagtgtacttttttaaaattcctgctctaaaactttttaaagactttcactcctgctctaaaacttgcctcagtctctccctctgccttatgcccctcagtcaagttctttcttctgaggtggcaagaattgaggctgctgcagacctgtacagattcactgctgctaacactttcacattccactgatcaggactcagttgcatggccacagctaacttaagtgaagatggaaaatgtggtttaactgtttgctcaggaagaaaaagaaacagtttagtaaacagttggccagtctctgccatacatacgtttttcccatttaatcctaacaaccctataagatatgtgcagtaacttatcccactttatggatgaggaaattgaaatcttttttacgtgtacaaatttatggggtacatgtgaaatttagttacatgtatataatgtggactaatcaagtctcgttttttttgttttgcatttttttttgtttgttttttcttttttttgagacagggtcttgctcatggctcattgcagccttgacctcccaggcttcagcaatcctcctatctcagcttccctggtagctaggactataagtgcatgccactgtgcctggctaatttttttattttttgtaaagacggagtttcaccatgttgcataggctggtctctaactcctaaactcaaaccatctgcccacctgggtctcccaaagtgctgagattacaggtgtgagccaccatgcctggaaagaaactgaaattttgataggctgagtaccatacctaatacctcacagttaataaatggcagaactcaaactcaaacctaggcagtccaactccagaaaccatattctttaaaaagctactgtaacatgactgatattccttttactgaagaagaatatttaagccttttttaattgtaagaggggtatgataattatggaactttaagtaaatacaaacccatcattttggagaagatgatactgagatttagaggcggaatgttctactgaaggttaaatcattgctgcctatgtaccatacgatgtaaagtaacatttttttaaagagaatgcaatcttggccgagcgcagtgggcctgtaatcccagcactttgagaggccgaggtgggcggaccacttgaggtcaggagttcaagaccagcctggccaatatggtgaaaccccgtctctactaaaaatacaaaaattaggccaggcacggtggctcacacctgtaatcccagcactttggaaggtcaaggcgggtggatcacctgaggtcaggagttcaagaccagcctggccaacatggagaaaccccgtctctactaaaaatacaaaaaaaaaattagccaggtgtggtggcacatgcctgtaatcccggctacttgggaggctgaggcaggagaatcacttgaacctgggaggcggaggttgcagtgagccaagatcatgccattgcactccagcctgggcaacaagagtgaaactccgtctcaaaaaaaaaaattagccaggcatggtggtgggcgcctgtaatcccagctattcgggaggctgagacaggaaaatcacttgaaaccaggaggtagaggcttcagtgagccaagatcacaccactgcactccagcctgggggacagagcaagactctgtctcaaaaataaaaataaaaataaaaaaaagaaaatacaatcttcacaacttaataacttatgttattctttctaaaaattaatttcctaaaccatgtagtttaatgtgatttaatgtagttaaatactagcattaaaacttgtttcttgaagggcgcagtggctcacacctgtaatcccagcattttgggaggctgaggagggcagatcgcctgaagtcaggagttcgagaccagcctggctaacatggcgaaaacccatctttagttaaaatacaaaaattagctgggtttggtggtgcatgcctgtaatcccagctgctcgggaggctgaggcacaagaattgcttgagcccgggagatggaggttgtagtgagccgatatcgcaccactgcactccagcctgggctacagagactctgtcaaaaaaaaaagaaaagaaaagaaaagcagaaacttgtttcttgatgaagtttgttttcctgggatcacacacagatctcccacggtggtccttcttgttctttctccttctgcaaagaccctggaaaccgcttgttgaagatggcggggccacagaatgaaaggagccttggtccctgagtcacggcttggaggaaagctttatggcgtttaggaacactattgtttgttggtcctgaagaggaagtacttcacagagcaagcctgccaccatgtggcgcgggcccaaacctagcatcagttaaaggttcattctcatttacttggttgcctctggttcacttactaaccaatctagatttaatgctgtctaataagaaattaatacccaggtgtattctataggtttaagtagtttttaatttcaagatacatttcttcaattctgaaattattgcaatatttccaaactggctacaggagtgaccacaacatttataatatgatccaggcacattcacaagaggactacttcagtgcatcacaaacatggaaacaaactcagcaatttgtaggatttatctcagttcactcaaaagttggtcaatgagccagattagaaggcagaattccggccaggtgtggtgggtcatgcctgtaatcacagtgctttgggaagctgaggtgggaggattgcttgagcccaggaatttgagaccagcctgggcaacagggtgagaccttgtcgctataaaaaataaaaaaataagaggcagaattccttggaatggaaacaggtagtgtgaaggactgccaaaaatggatgaaaaaccctcatggaaggagagtcagaacttaacagtttcctagagttttaacaccgtataagctcactatgttctagcatgccaggctgacgtttcccagaactctctctacatttatcaagacaggaatgacatcggaagttgtttgcaagactataggtctagcaggtggctaagaggaagtctggtattgctgctgcgtctatttttatgtatttattcatttattttttaagacgaagtctcactctgttgcccagccaggagtgcagtggtgcaatctcagctcactgcaacctccacctcctgggttcaagcaattctcccacctcagcctcctgaccacctcccaggttcaagcaattctcctgcctcaccctcccgagtagctgagattacaggtgcgtgccaccacacctggctaattttgtatttttaatagaggggttttaccatgttggccaggttggtgtcgaactcttggcctcaagagatctgcccacctcagcctcccaaagagctgggattacaggcataagccactgtgcctggccttggtatagctgctgcttctaacacttgcttctaatgattggtgggtggaggcagcagtactcacattctgatacagttattaaatgttcctttttttctttggtcctattactacttctttctttttctaccactgcaaactctgaaatatctattacacataaaatgtcaactataactcacctgatttcactgtagaaagcaattaaaagggaaaaattgtatttacttgagggtgaaaaaaaaaacccacatcatccttttctttatgttccttttttacactgatatataaacttgttatttccacctaactaaattgattcatttaatccagtgactgtggttaaattgaaaaaaggtttgaaaagagggggtgtctatggaaacccaaacttcttcacactccagctttttcactaccttctcacctccccagcttccacattttcgcaagcatgggtatatatgtcccaaggctgtggttcccaggggccaaaagtatatgaataagcctatattatgtaaacctttcatcttttaggacatgctgtgccttccatttagagcatttatcatctccattctgatcaccatgtaaccagatatgatgggcccagtgatagcttccctagaagcctcatcactccttgttctagaaaggtcaggtgcagatggcctgactcagcccagctctagagactgggacacatctctggttcttgttcattcttctctttggcctatgtgttacaaatcagccttccttatcattgaagtagtatgtatgggcttaggaaagagatcacttcctttttcttaaagagctcaccatatggtctaatctaaactagctcagcaggattctatagtgggatctgaggttttagtgaaattaaatgtgctatttagatgaatattgtctagattccctatttaaaggaaaaatggttcctttccatataaaataaatgtattgtttctgtaagaaatttcttacattcttttctctaatcatctctttgcaatatgtgatggatattgcttttttttttttaagaggcaaggtcttgctcgcatgatcatagctcatggtggcctctacctcctgggttcaagtgatcctcccacctcagcctagctgagactacagcctacctgggactacaggtgtgtgccaccatgcctgactaaaaaaaaaattgtttttgtagagacaggatctcactatgttgcccaggctggtctcaaactcctggcttcaagcaattctcctgtcttggcttcccagagtgctgggattacaggtgtgagtcactgtgcctggccaagttattgctaaatattaactgaattacaattgataaaaaataatatcccacttatgttctaaaatattccagactaaaatataacatccttaaatattatttgctattgtatactaacctttacctatgtagccagatttcacaaatcttacaatataaattttccccaagtcttctccatgaattatattcctttgtatatgaggaaaaacaaatggcaactgctgtttctttgtatgtgctcataattgaatttaaggggtcctcaaacttataaaggatatctgtcaagaacctagagaaaatattacatttaatggtaaaacattagaaacatcaccactgaagtgatgtatggatttttacaaaatatggtcacaaattctttggcaccccacccattgagaggtggcatctttgtaccctccctttgaattcggatagacttaacgatttgcttgcaaacaataaaatgcagaataagtggtacacactgagaagtgtggcttctcaggctaggtcagaaaaggtgacacagattcctacttgttcactggaatacttggtctcagatccctgagcctccacataagtggtctgactaccctgagaatgccatgttggaaagaggccaactaacatgtagaggccatctgtaagcactccagttgctagtctcactgagcccccagctgacagcagcatcaactgtcagccatgtgagtgagccattctggacatccagcctaggtgaaccgtcaggtgacttcatccccagctgacatctgactgcagctgcttgagataccctaagtgagaacaatgtgatctagcccttcttgaaatcctgaccctcaaaatcataagcaaaacaaaataattgttttaagccactaaattttgaggtaatttgcttcacagcaatagtaacaaaaacagacaaggattaggaaagtatgccctctgtcactgctgttatttaatattcaactagaacttatggaccaataagtaaatgaaacgggaggcctaatgttggaaggaattaaacacgaccatcgtttgcagacaatgattgtctccatagacaagtcaagagaatccactaaaaaaacaattagaacaaagaagagttcagtataagtttaatttaatataggaaagacatataaaaattaataactaattagaaaatgtatttagacaaaagcgccattaccaataacagtaaaaaccctaaaatacttagtaataaagtttaaaaatacataaaggctatatggagaaaatgtctaaagttcactaaagggcagaatttctaggaatagtatcatagaagacattgggcaatttcttccatagataatgattataaaaactggacaaatttcttaaaaacaactatttgttggtgtttttgttagatgactcttgagaagggtttactcttgaatgacggatactgcatcaggtaaaaactaagagtttgtgacccctaagcagggggtcactccccaacaccctccagctctagtggcagaaaaccacagccataccagcttgaggtgtcagagaataaagtttaaggcagcagacaactggatattcaaggggggaatcctgtaaaaatgagagccagagccacagaaggactgaattgaaaagctgagtataagctccgctcaaatccctgcctgcctgctaaactgctgagacacacaagagaccccaggcagcccagtgaaaaagcaagcagagactagagaggcatctacccttgtgagacagaactgctcctggtgaggtttgtgagtttgctgcactgttgacttaacatgcacaaagctcaggtcttgcagaaagcaaaaaccttattggcttgaggtgccactgggcagaacttggggctggcagagcaactggatatttaggaagaaagcaagggagctgtacagtaggtaagcttcaatacctgaatataaattctttccaaatctgtggctgaccctaaactacacaggctcaggaaagactcccaggcactaggccaaaaaagaagcaactggatcctgagaaaactgtgcagaagaatacatcaactactataaattgctggggacagatttttcagtttaaatgcaggcaggttaactgcctactagaacaatatggcaacaaccctcagaagaacaaaacagaatcttgagtgggtataacattactacaatgtccagtgttttttgttttttgttttcttgttttttttttttgagacggagtctcgttctgtcgcccaggctggtgtgcagtggcgtgatctcggctcactgcaagctccgcctcctgggttcacggcattctcctgcctcagtctcccaggtagctgggactacaggtgcccggctaattttttgtatttttttagtagagacggggttttaccttgttagccaggatggtcttgatctcctgacctcatgattcacctgcctcggccttcccaaagtgctgggattacaggcatgagccactgcacccagcctacaatgtccagttttaaaccaaaaattactagacatgcaaagaatcaggaaagtgttactactctcaggaaaaacaaaatcagtccatagcaactgaatcatagtgggctcaaatgttggattcaacagacaaagacttcagagcagctattgtaaatatgttcaagagttagtaaggcacatgtttaaagaacataaggaaagtatggcattactgagtgaacatgtaggaaatgttaatagagaaatgaaaattctaaaaatgaatcaagtagaaattctcaagctgaaaagtataatagctgaaagttccatgaagaatacaaaggaagacttgcataaatggaaaggcaacacatatttctagatgagaagtctcaattgtgtaatgatgtcaattctccacaaatcaatctattaaaagctaccccaattacaattccaacattatttttccaccaaagtgtttaatgaaatttgaaaacatgatcttaatgttcatatgaaaaagagagtacagactgggtgtggtggctcacgcctgtaatcccagcactttgggaggccaaggtggaggatcacctaaggtcaggagcttgagaccagcctggccaacatggcaaaactccatctctactaaaaatacaaaaattagctcagtgtgatggtgtacacctgtaatcccagctactagggaggctaaggcaggagaatcacttgaacctgggaggtggagcttgcagtgagccgagattgtgccactgcactccagcctgggcaacagagtgagactgtctcaaaaaaaaaaaagtacattaaaatgaccacaagattttgtaggtaaaatatagagggcaggagacttttcctatcaaatacaataacattaaagatattcattaaactaatgtgatattagcaaaagatccacagatagaattgtggaatggaatatagaaggcagaaacatctaaacccacacatacatataaatatatgaatttagtgtacaataacagcgatacttcaagccagaaaaaaagatagctcatttaataaataatgcttattaaattcatctaagttgtttgttatatcggcataaagttttctataatatcctccttgtcagcttttctccagctttactgaggtataaactgtacatgattcatgtatacaatttggtgagtttggacatatatatccactcatgttaccataaccacaatccaggtaataaatatatccatcacttcatcacctccaaaagtttccttgtgtccctttgtttatgttttttgtttttctgtggtaagaacactaaatttgagatccacccttttaacacaatcctaagtatgcagtatcttattgttaactataggcaatatgtgtacagcagatatgtggacttactcagcttgaataaatgtaactttatacttttaaagtacttcccatgtccctctcccccgatcctctggtaaccaccattctgttgtctacttctacaccttcaactattttcaatgtctcacataaggggaatgatgtagtatttgttcttccgtgacagacttacttcacttagtataatgtcttccaagtccattcatgttatcacaaatgatagggtttccttctttttttttttttttttagatggagtcttgctctgtcacccaagctggagtgtctcagcctcccaagtagctgggattataggcatgcgccaccacgcctggctaatttttgtgcttttaggagagacggggtttcaccatattaggctggtctcgaactcctgacctcaggtgatccaccagcctcggcctcccaaagtgctgggattacaagcataagccaccacgcccagccctgggttttcttcttttttaaagctgaatatgccaagtgcagtggctcgcacttgtaatcccagcactttgggaggccgaggtgggcagatcacgaggttaagagttcgagaccagcctggccaacacagtgaaacactgtctctaccaaaaatgcaaaaattagccagatgtggtagcacgtgcctataatcccagctactcaggaggctgaggccggaaaatcacttgaacccaggagaacaaaaatgagcccttggacatttaaaatataacagcagaagtaaatattgtgatggaaggattggaagataatgttgaagaaatccagaaagtagagtgaaaaggcaaaggtgtaagaaaggaaagaaaatatttttaaaattagagactaagcagaatgcaacaatcaaataataggagttccagaaaaagagaacattaaaaatggagtggaggccaggtgtgatggctcacatctataatcccagcactttgggaggccgaggatggtggatcacctgaggtcagaagttcgagaccagcctgggcaacatggtgaaaccccaactgtactaaaaatacaaaaattagccccgtgtggtggagcatacctgtagtcccagctactcaggacgctgaggcaggagaattgcttgaacccaggaggcagaggttgcagtgagcttgatcatgccactgtacaccagcctgggtgacagagcaaaaaagctattactgattaagcacattatacattatatctacattaatttatttactcctcccaacacctctgagaggtaatttttttgtccccatttatagatgtggaaactgaggctacataagattaagtgccttgcctcagactagttttgttgtttttgtttttttaataaatagacacagagtcttgctaagtcaccaggattggtctcaaacttctggccttaagcgatcctcctgcctcaggctcccaaagtgccgagactatagacataagtcaccacaccaaccagcttagtttttttcttttcacttctaaatattatatcattttgtcaagaactacttttatatatgtgaaaagggatcaatacaaaagctaagaaagaagcaagcacaactctatttttatttatttatttatttattttgagatgtagtcttgctctgttgcctaggctggagtacagtggcacgatctcaggtcactgcaacccccgcctcccgggttcaagtgattctcctacctcagcctcctgagtagctgggattacaggcgcctgccaccacgcccaactaatttttgtatttttagtacagttggtgtttcactatgttgcccaggctggtctcgaacacctgacctcaagtgatctgcccaccttggcctcctaaagtgctgcgattacaggtgtgagccaccacacccagccagcacaactctttctagaagggaagaatgacattgccactattggatgaagactcccaggagaagatgatgaggtgaagagagtctctgggtcagagtctgaatttcactcccttgggagccttacaagagccccttctggggaggaccgtggacaaagccatatcttaggaaggataggcctcagcatattggggcaatattgacagacctttagtgcaggcccagctctatcgtccagcaggaatatggccttgggaatgaactactgtgcgcgatctacttcaagacacagctccagtctcatgagtgagcaaatcagaatacgtcttgcgggttgaagggagaatccttagctggtcgtggctgtggggcctggatcctgtgctgatgaagtttctcccttccccttcatgcaaaataaatactttgctcattgatgcacagggtaatggtaagtcatctgggaaatccagccaagtcacaagcactaatcttagtttctaactatgaagtgaccttccaacctccttcctaatcaagttaggtttttttggtttgtttttctttttcctgcaaagtaaaaatatccagttcaggaaatgtggctgattgaatagcagctgccatggaggacctactttggatattgaaacaaccttggaagaagatcagaaactcactcccatcagctcctgttttgaggcaggcctggagctcatcacccagattagtcttggcctccacattgtccttcctgtatatttttaggagaaagtatctggccactgtttctttttcctctcaatgctaggaaacttcctgtaatattggaaaagtagaagttgaagcggcttcagtgcaaaactaacattctctggatctttctcacgctgttcggaaagtagatcacccactgttatttccttttcctggcttttttttttttcctaacagacaaagagaggcactgccacgatactatttctgttcagagggggagagagagcaaaaagagacaggcagaaacattttccccagccttgccacattcttcactcagttataaagaaacgcattgccaataaaatagaaaacagaaatagcaggaaaattctgaaagatgagctgtgctgtaaatgtaaaacacaagccacttaatgcataatcattcaaaggacagtttgtaatgaaaataaagacatttcaaaagagcccataatttgcttacattacattctgtatctaattgttatagtatgttttattcctcttatacaagaaaaaatgttgacctccctcattcatatggcatgcagatgcatttgagcagggttttttgggtttaataatgtgatagactggctgggcactcatgcctgtaatcccaaccctttgagaggctggcaggcagatcacttgaggccaggagttcgagaccggcctggccaacatggtgaaacactatctctactaaaaatacaaaaattagctgggcgtggtggcacatgcctatagttccagctacccggaaggctgaggcaggaggctgagcttgggaggcaggaggctgagcttgggaggcaggagactgagtttgggaggcagagggctgcagtgagccgagatcatgccactgcactccagcctgggtgacagagtgagactccatctcaaaaaatatatatatgtattatagaatattagagctttagacatcacctagtgcaaacttcttgctttacagattagaaaattgaggcttagaaagtctaagtaatggccaagcacagtggcaaatgtctgtaatcccagccctctgggaggccaaggcaggaggattgtttgaagccaggagttcaagaccagcctgagcaaaacagacagacccccccaccccaatctctacaaaaaaaaaattttaattagccaggtgtggtggcatgtgcctgtagccctagccctagctacttgggaggctgaggcaggaggactgtttgagcccaggaatttgagcctgcagtgagctatgattgcaccactgtactccagcctgggcaacagagcccgaccctatatctaattaataataacaaaaagattaaataacttaacccaggcaacacagatggaaagtagcagagctgggggctagaatccagatctaaatcttcagcctgcattcttcctaatttatgtggagcctcacactgtcttgccctgtcccatgtgcaagatagcagccgagaatgactactgcagcattccttctgatttccttatttctgacttgaatatgctacaccagtaacaaaactatgagcacccaagacacaaccacacgcatgtgcacacacagagacgcacacacatactgttaacagatactgagacaaagatcttggaagacagcattgtcttctgaaaagagaatcttctgctatggaatgtctgggaaggaagtgtgacagacgttttcactcacccaacacctttcccactttcttcttgctacaagtagcataattttattcagatagcatggagtgggggcagacagggtgggggcaatgcgctcagagaaggtagacccagcctggccaagccaagtaattttattctcctggtcaggaagatgtatggagaaattggctggtaggctttaggaaaacatttcattttttattacacaaatgcacacacatgcacacaagcagccaaaaacacttacacctttccctttcttcctgccttttttttttctttgagatggagttttgcttttgttgcccaggctggagagcaatggtgcaatcttggcttactgcaacctctgcctcccgggttcaagtaattctcctgccttagcctcccaagtagctgggattaccggtgtataccaccatggccagttgatttttttgtattttcactagagacgtggtttcaccatgttggccaggctggtctcgaactcctgacctcaagtgatccacccactttggcctcccaaagtgttgggattacaggcctgagccactgcacctggcctcttcctgcctttcaattcagttttgtgagaataagatatttgatgttgctgcacaacattgctggggagtcatcacacctaagttgacagtgctgaagcagaaacatggaaagagaccggctctttgatgacacttgagctgcgaaactgacctggaatgacctccttccagatgtattgtcatgagagagaataagacaatctcattgtttcagccacttgcagtgggtgttttataacttgcagctgaaagcatagttacctctctgagcctcagttttttcctttagaaaatggcgataacactacttacccagcaggtcgtaggaggaaatggtataatacaatgcctaacataaaggaactcagtaaatcgtagctagtcatatcataatcatgataaccctcatagcaaaatcctcagtggtgggaatgttttctccactccgccagtgtcatggcatcgggttgcttctccctacagtggtggtctggagacagtttgccccgctgccacctcttctccaagtgctgaggagctcaggcatgggagctttgggcctgggagctttgggccggggaggtagggagtccagtctgtaaaggaaaacaataaaaatgaaaagcaagcatgtaaaatcataataacatattgaataatcttagcaagccacaaagtgttctttattttttatttatttatttttttgggacggagtctctctctgttgcccaggctggaatgcagtggcatgatctcagctcactgcaacctccccctcccgggttcaagcaattctcctgcctcaacctcctcaggaactgggattacaggtgcctgccactgcacctagctaattttttgtatttttagtagagacggggtttcaccatgttggctaggctggtcttgaactcctgacctcgtgatctgcccgcctcagcctcccaaagtgctgggattacaagcatgagccaccgcgcccagccaagtgttcatttcttatgtcccagaagtcccaactctggcaatctagcccatagaaataatccaaatgaagagagaaattttactcaccaaatctttaattcagatttttttgcagcctttagaagtaaataataatatatccccttgatataatataattatgaagccaacacagtaatgtttattagaaactatgtaggggtggcccggcgcggtggctcacgcttctaatcccagcactttgggaggccgaggcgggcggatcacgaggtcaggagatcgagaccatcctggctaacacggtgaaaccctgcctctactaaaaaaatacaaaaaattagccgagcatggtagctgtagtcccagcgactcgggaggctgaggcaggagaatggcatgaacccgggaggcagtgtttgcagtgagcctagattgcaccactgcactccagcctggacaacacagcgagactccgtctcaaaaaaaaaaaaaaaaaagaaactatgtaggaataaggcaatgtaattcttaatataaattaaatgaaaacaaaatcagaatacaaaattgtatgtgtgctctgcttacaaccacgtggagcacagctataattaaagcgggctatacttggcacactgattgttaaataagtgcagcgaacacaggaaataagggggctgcgggttgttgaagaaactggccagaaaacggaacgaagaggagagaagctaacggtgctcatcgtgtggcacgcaggtgcgttgttttctctccactaaggctgctgggtggggccaaaatagtccaggcagccaagtgcagaggcgttgggggcggcaaagatgcaaaggatccccactgtggctgcaccccgaggaggagtccgtggcaggaggcccacacccaggacccggcgccaacagtgaggagacgaacctggaagacatcccgctgtccagacaccgcgagggaggcgagtggtgctcgcagcctgggacttaggaacacagggaaacagcttccacatgccatttgctgaataaatatttcttgcaggatgtttcctatggattcattctctatcatgaaagctttatttgtggtcagcgtcctaggaaagcagaggcagacagatttctgttctagggagttctgtggagggttacagatcagcaatattccactgaaaccaaatacctaggaaaagcatggaaggacacacagaaatcacaaattattatattatattatactatactatactatactaatattatattatattatattatattatattatattatattatattatattatattatatatttattttttgagacagggtcttgctccgtcatctaggctggagtgcagtggcgcaatcatggcttactgcagcctcaacctcccaggtgcaggtaatcctcctgcctcagcctcctgagtagctgggactacagctgcatgccatcacacccgactaatttttaaattatatagttgtagacatgggttctctctatgttgcccaagctgatcttgaactcctgggctcaagcaatcctcctgccctggcctcccaaagtgctgagattacaggcatgaaccaccgtgcctggccaaaatgtatattttaaaaaacatataaaaatagagttggctgggcgcggtggctcacgcctttaatcccaccactttgggagaccgaggctggtggatcactaggtcaggagatcgagaccatcctggctaacacggtgaaaccccgtctctactaaaaatacaaaaattagccaggcgcggtggcgggcacctgtagtcccagctgctggggaggctgaggcaggagaatggtgtgaacccgggaggtggagcttgcagtgagccgagatcacgccactgcactccagcctgggcaacagagcgagactctgtctcaaaaaaaaaaaaaatagagttaataaatatatctatgtgttatagatataaataaaatgtgtttgcaatcattatctactgtgtcctataactaattaagatcttcacccataaaaatcccaaccctattatgaatttggagtactttctggtggtggactcacactttttcatgcaagctcctttgccccctatgcaaccactgcccacgttgtgctccagggcagaccatagttcacaggcggaagcaggtgccatgtaggaatgagaccacatgtaccatgaagcaacggagctcactgattcagaggcaagatgctggcccctctggctgtcaccatggatgactgctgatttaaggtctttcttggtcatcccacctggcaccaccacttctggtcccttctcttcagtttcctctacccagctatgtcctcctctactgataagccctgaaacagagcaagtggcctcttttttaatgtaacaaatattttacaatattcatttgtaaagtctagaaatgaaaataatacacaatagcatctacctagccacacaatcttgaaaaacaatcagtataatgctgtaactataacgtaagaaataaatgaaggtatttatttatttatttatttatttatttttagagacagagtcttgctctatagcccaggctgaagtgcagtggtgcaagtggtgcagcctcgaactcctgggctcaaatgatcctcctgcctcagccttctgagtagctgggactagaggtgtgcaccactatgcctagctaatttttaacttttttgtagagactgggtcttgctatgttgcccaggctggtcttgaactccttgttgaggatcagtgggagatgaaagggaggagagacagtgaggaccccttggcactacccaccttccctacccaccggcaagtccccaatgagtgatgtccagtatgggtctgggcggggcaagtgatcctcctgcctcagcctcccagagtgcttaaattacagatgtgagccactctacccaacggaaggtaatttgaaataaaataatacatgttcccatacataagtgctcaggacaatcacattaatgaagttgtcacgttcttgcatctaaatttagaatccacatgagcaccatggcagtggatcgccgttttggtgcgtcttatcagcaacttaaatgccacgctgttattcaaagcgctgctgtcagtgatgtgattttccaaaataatgagcagctcttggaaaagctccaaacagaacaaagtgcaaactttcctcaatgcatacagtagttgtgtttctggaaagtgtagtgtatatgaaaaccacatgaaaatagtctgcggttacatataaaacaaaattaggttctaggatcagatagtttttattttattttattttattttattttattttattttattttattttattttatttttgagacggagtctccctctgtttcccagcctggagtgcagtggcacaatcttggctcaccacaacctctgcctcccaggttcaagtgaatctcctgcctcagcctcccaagtagctgggactacaggcacgctccactatgcccggctaatttttgtatttttagtagagacggggtttcactatattggcgaggctggtcttgaactcctgaccacgtgatccacccgccttggcctcccaaagtgctgggattataggcttgagccaccgagcccagcccagatactttttaaatggtgttttttttctttaaactactacataaatgtttgggacattcaaaagtgaaattcaaatttaagaaacatttttttcttgcacaaaatattcttgggtgttataggatgtctagcatctctagtccccactcactgaatgtcaggcacatgctcaaatcaaactctccaagagtggtcattgagaactactctttcctgtatatgagtagaccttgtactctctgtccacttttctccacatctggggaaagctgaatcatgggcataagtacctgtaaacagtcactgatacacatgttacatctgtagcaaccaccccaaattcagatatatagcttagggccccatgggttgcctaatacatgatggtcatagagggaggaaatttctcggagaatttcattcaaccttcagcatgattggagcattggttctcaccacagtacccacaaaggtaacttgtaccccacccagccccatcttgtacatcactcactggggacttggtggtgggtaggaaaggtggatggttcctagggttcctggctgtctctcctcccctttgtctcccactgatcctcaacacagctcatggctgagaacttctgattgagagatttatacaagaaattgcattcctcaaagtaagtgattattgagggaaaaaaaaaggaaaaccatgaaaaaaaccccaatgcaccctacttgcttatatgtgcgtagaatatctctggaaaaatgtctaagaaaccaatggtgtgagctgtttcccagggagggtctggcatggctggagcactgcggtgaaaggagaacgtccttgatgctctactcttttgtaccttcagaattttgtatggatggcttgaaaatagaaagaaatagaatttgatttttaaaagaggcagtccctggaaaaaagttattaatttgcatattgcaagttgagaaagtgagagaccagagcaagaggaggtcacaacaagataaaaaggtgggggccgttatggagcccagggaaaggagggctggacaagagactccgtccatgtttctctagcactttccaggagaataaagctcttgttctagcactctcctcctttggacctatctgtagagagcagaaaagtgaccacgaggctctgttgcatgataaacaaccccttaaaaaccaccaactttccatggtcttccagcaacccatttggatgtcgtccctacagttgactccttcagtccctgtgtgtgtcctctgcgtgcccctggccccctgccttcccttagctgtgctgcacagaaaaccgccccagctcttgggtcaaacagatcccataagaaacatcagaagaagcatcctggcttacaagttattttttggtgagtgcaatgggcgtgccgtgctcctccaggcctgaccacctgtatgagagttggcaggaggacatttctaaactcacactcttagggcagtagagatggggcctaagacctttgtctctcctggtatcagtgagccccgtgtagccccttttccttattccaggtctggaagctgcagtcacagacacacaaaggtgctggggcttgcacattcaccagcgtcactttctccagccacaccactacgtttgagggctctcctgtccttctctaacagaactagtctgggactagacgccaggctttgggctaagtacttgatgtgtcttcacttattaaatccttccaataacccttcaagttaggtaccattattatcgtcatcaacctcattttatagagaaggaaactgaggtgcagagaaattcaggttgaggttcacagcaaataagcagtggaggccaagtgtgcccccaggtggacccaaatcaaagccacactgttaccttctgctctgcgctgcctcccggggcagtagccctcgtgagcctccccacgttggggtgtctaatgaaaagcttccctgctggttgagctgaaggggtcagggtcggggctgtacagagaaactcaggccacaagggcctttgggcagaactggggtcacaaagtaatcatggtttcccagcgaacacaagactttggccctcaggcaaggctccttgatgtctgggggagcctgtgccccccagcagtgctcacagatccacccctgactgccagccggccccttgatggcggtgcctgtctcagattctgtggtcagtgccacgcagctacctccagaggcagcctgcagcctggccatgtggccccaagctccaggctagaggccaaggggagtgtcccttctctctctgtgtcacccagggcataggtcacccaggcagcctggcatggtgcctccaagccactgtgctaatgcttctacagcttctgctccctccctgcctccatggggcccaaacctagccctggtgctgctctgggaactgggtcagagcagcaccccagctcccccacccccaggagcccctcaaccttggcctgctgtcatcctcgtccggccccaatcttcctgcaaatcgggcccttgcaggattcctgctgactcagcagctgggcccggacaggacttagtcccagcgtgagccgatcccgctgcagtttgggcgagaatgacaagccctccaccagacgattctttattgctctgagacttccctgggataattccacccccaggagcactctatctgtttctgtctcctccccacacaccccctggccttgaaaaaggatgatcactgaccacaggcactgaaaagagcaaaccaagagcagcatcaataccctcacacagtggtgcacataacacactttgagtttctgacttttcctaatcagttcttcctgctaaaatacagtagcttaacaaaaacaatgacaacaacaatctggtgtttgccatttacaaggcactttctgtgtgagtagcatgacatggtaaaagagaaagagatgaattataaaacgcagcaagatcatgagtcaatgattcaccctgtcccagcctgcttctttttttttttttttgagacagagtcttgctctgtcaccaggctggagtgcagtggcgcgatctcagctcactgcaacctccgccttccgggttcaagcgattctcctgcctcagccacccgagtagctgggactacaagtgtgcgccaccatgcccagctaatttttgtatttttagtagagatggggtttcaccatgttggccaggatggtctcgatttcttgaccttgtgatctgcccgcctcggccttccaaccgagcctgcttcttttcttgtaaaatggaagagtcataacatccaacttgagtcttgatattttaatgaaataatgcatgggaaagcagaaaacagcacaaagattactggttataagagctaaatcactgtgactccatatccaaattcaatacctactgaatcagtggtttctgactagtcaattttttttctttttttctttttttttttgagacagagtctcggctgggtgcagtggctcacacctgtaatcccagctctttgggaggccgaggcgggcagatcactcgagattagaagctggagaccagcctggccaacatggcaaaaccctgtctctactgaaaataaaaaaattatccaggcatggtagcacgtgcctgtaatcccaggtactcgggaggctgaggtgggagaattgcttgaacctaggaggcggaggttgcagtgagccgagattgtgccattgcactccagcctgggcgccagagcgagactccatctcaattaaaaaaaaaaaataggagagagacagagtctcactctgtcttctaggctggagtgcagtgctgtgatctcagctcactgcagcctccacctcctgggctcatgcagttcttgggcctcaatctcccaagtacctggaactacaggcacacatcaccatgcctggttaatttattattttttgtagagacgtggtttcaccatattggccaggctggtcttgaactcctgagcttgagcgatcctcctgccttggcctcccaaagtgctgggattacaggcatgagcccccatgcccggcgactagccaattttttaaaaattacattttctagaggtgtcatttttactgggaaaaacacagtgacaccattcaagaaaaaattgaacggtaactttaatcactacattaacacaattttaaaggttgatctgcatcatacataccttttaaagaatgttttcatcatatgtagacagctttttttgttttttgtttttgtttttgttttgaggcagagtctcgctctgtcaccaaggctggagtgcagtggtgtgatctgggctcactgcaacctccgcctcccgggttcatgccattctcctgcctcagcctcccaaatagctgggcctacaggtaggtgccaccacgcccagctaatttttgtatttttagtagagacggggtttcaccatgttagccaggctggtctcgaactcctgacctcgtgatccacccacctcagccccccaaaatgttgggattacaggcctgagccaccacgccctgccataggcagcttttaaaagaacacatgtgcagcctggccatcatggtgaaacctgtctttatgaaaaatacaaaaatcagctgggcatggtggcacctgcctataatcccacttgcttaggaggttgaggagggaggatcgcttgagccctggaggcggaggctgctgtccagcctgggcgacagagcaagactcggtctcaaatagaaaacaaaacaaaacaacaacaacaacaacaacaaaccatgtgtgattccaagcaaatcagagaatctctagccaccagaaaaaccttgaggcatgtactgaaaggaagaggtcagaattctctgcgaggagctcagaggatcctgagggaagagagaaggcggctgcgcttggacacagctccgagctcgtgctccctccttcaggcacccaagtctgagttgctaaaaaatggagctgtcactgggccttgctctgccaggacctgcagagccggggacctctctgtggcaagcccagcaagatgactgctctgaggcgccctagggctgagggaggggccgtgacaccagccccgccccccagccacctgggaaaaggaagcacaaaaaggagaagcagcaacggctgctctgcttccttcccatctcgctcttgggtcatgcctggccagcagaaagcagctccataggggaggagagccacgcaggatctcacagctgcagtctaatagtaacacagaggtaattttaactttttacttttctacccttgggagtagggatgagtagaggcttacctccttccagaggcagctcatatccccccacccccattcccggaagttgagatgtctcttctctgttccacgcaggcatcgtctaagttgggaacaggtcttatgtcttaaaatttgggattctttaaaaacatatgtggctgggcacagtggctcacgcctgtaatcccagcactttgggaggccgggcaggtggataatttgaggtcaggagttcaataccagccaggccaacatggtgaaacctcgtctctaatataaatacaaaaagtagctgggtggtagtagtagctgtaatcccaggtactcgggaggctgaggcaggagaatcccttgaacctaggaggcggaggttgcagggaggcagaggttgtgatgagccaagattgcaccactgcactccagtctgggtgacacagtgagaccctgtctcaaaacaacaacaaaaatgtgtgatggcacatgcccatagtcccagctactggggaggctgaggtgggaggatggcttgagcctgggaagtcgaggctgcagtgagctgtgatcatgccactgcagtccagcctgggcgacagagtgagaccctgtctcaaaacaaaacaaaacaaaacaaaacaaaaaaacccaaaaacaaacaaaaaagcacatgtggagtgttgtagaagtcattgaccttggtaagacagtggaggaaactgctttgctctgactcataaatttgcccccagtaaacagtatttataaatagccccagtcaggcactgcatgaagacatttcagtcaacgacagaccacatatacaacggtggtcccataagattataacagagctgaaaaattcctatttttcagcttagtgttgtggtgcaaccactaccttttctatgtttagatacacgaatacttagcactgtgttacaatagcctacagtacccattacaggaatgctgtaccggtgtgtagcccaggagcaatgggccataccatatagcctaggtgtggagtagactagaccatccacgtttgtgtaattacaatctatgattttgtaaaatgatgaaattgcctaatgaagcatttctcagaatgtgtccccgtcattaagtgacacctcactgtgtttccaagacatagtactggtccttgggaagctctaaagagaggtcaccgtgagctgaaccatccttctcactctgtgcatggaacccagcttagcttccatttcagcatttaggcttataggaggagaagaggttagaagccacagaccagcaagaattgaagacatcgttctgtaatttctactgaaccagctctgtctgactggaacttcattttgcctctttgctttaactcctcaggaatgtcttccaggaggcccctgatcttctctgctcagggaccactcttatctgacccagagacaggttagctgatggtgactcacacatcctcacttccttcaaagcccaggcatctgtttaaaatctgaccctgtgaagacttttcctgttttggaaaaactcttccgttgtttgcctgcacagatttgtgctccatttttaatttcaatttttgtagagaaggcgggtccttgctttgttgcctcggcttgtttgaaactcctgggctcaagtgatcctcctgccttggcctcccacagtgctgggattacaggtgtgagccactgcaccaggatggatttgtcttccttcagaagacagtagctgatgtgtgccctggcctttctcccctaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcggcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataataataataatgatgatactctaagaaaaaaatctcaacatacttcatttaatagctcgttaccaagtgtgaatgaagcaatatgtcataatagagtagccactggttgcataataatagagacctaaattctcaaatagggaaagaggttttaaaatcaaatttgaggccaggtgcagtggctcatgggcggaggagggcagattacttgaggctaggagttcaagaccagcctggccaacatggtgaaaccccatctctactgaaaatacaaaaattaggcatagtggtgcacgcctgcagtcccagctactcaggaggttgaggcagaagaatcgcttgaacccaggaagtggaggttgcagtgagccgagattgtgctgctgcactccagcctgggtgaaaaagacaggctgtgtctccaaaaagaaaaaaaaaagtcaaattcaaatatcatctggacatgtcacaatggatcgcggatccttatgagtgattttccccagtggcccctggggatgtgccactgtcactcagaagggcaagctaggcagggcccatacaacagcaggggtctgcaggttagacgttccctgccctgggacgctcacccctgggcaagaggctggaagttcacaccatccaaaatttatccttgttttttttctgatgctaattagcctctcccgattttatgacatcttgtgttgatctttttcaaaaactcattttcttttttttccttctcttttctccttcttgtagcacatatctttcgttaaagatcagatcaataaaatattttatttattcattaatttaacaaaaaaaacagagcatttagtttgtggcaaaaacactgagctttcgaatatgaatcatgtgctttaggtgggaattgtgaattctgaagatacagatgacagtgacgaatgccttctgtctcatgattgacagggaaaaggaaggttgaccatagcatcctagaaggctcatcaggtgatcattacctagcatccatgaagcacctgaaattatttgcaaaatgttacgctttggaccatttttccggggaaggagatccagaactttttaccagattttcaaagacatctgtgactcccaaaagttaacaatcactgatgtggttgttgtatccctcatccaaccccagaacactttctgtaatctgagttttttaatggcaagtggcctatatttagcacctgttctcatgttaaacagctctgaatgttagatattctttcttatcctggactggttctctctatctctggagtaatgcagtataaattggccatcagtaccctcctaaaatctgagatctgccaggcccctcttctaacaccaggttaggcatgcttggttatttccagtacttgtcagtcaacatgtttcaagacgctgtgttagacactagggatgcaaagatgaatgagataaggcctcaggcctcatggaaggtgagacagtaaagacattactcccataaaaatgtgaggagagagactcagttcagcaactgtttattctgtttattgagcacttacttggaccaagcactgtggtcttggtgttttacatagactgtctctaattctcacaactctgcaaaatatatatattcccattttataaaactacaaactgaggctcagagaaggtgtgacctcttgttgcttgaggcacagagttataaagtaacatatctggaatttgaaatcagatctgtttagggctaatgctgcatttttctacaacatcatgcctctagaaggtttaagctaggtaggctttcagccagcagacatgatggggagagccttctaataagagggaagagactgcttggaagcatgaagggaggtgtaagaaagataagtaagtcagtgtacttgcaacagaggcttgggatgaagggtgggtgaagttgacatcacgatagaaaacaaaactggaatgggagtttaggtccaatttgggcaaggttgtttgaatttcaataatcaggggtttgggtcaaggaagaaaaatcatgggacttgccatttaggaggataattttgtggtagtgtggaggtgaaataaagagaaaagggaaccttggagctgggaaggcaggaaaccggctagatgaccatcacacagcaaaggagggagtggaagagagatgagaaaattgagagctattattaagaaaaacagttgagagaggaagaatttgaagagggctcaagattttgagtccacatgacagaaggactggaatgccatgaactggagaaggtgagcgctgaagaaccaggatgggacggggctggaacagctgggttcagcttttgcagggtgggtacgtgtttggttatagctgctttcagattgttccattatctgtactcccaacaaccctgccggatatatttgttggctttcactcatggaggctcatttccttgcatgatttgtcacttttgattgtgagctcatctgcagtaggagttgtttatcctgtgtgactcccatgtgccctggtctgtaacaacatttctacagagtggtatctactaggatcctggggatttcaattattttagaccaaatattatgtcagtttctctgcctggggctactggacctcagaggtagtatacatctgaactgtgtacccattcaatgcacaggccttagggattccatatgtgacaggtgactttttttccttgcctttatgttgtaagacagacagcctgcctcctcagacttccctgagctggtgggcagcattttttgaaccctcttttaaggaggggtcatctctctgatgctcttcttttttgctgagctcagattaacattttctacctgggtgcagtggctcatgcctgtaatcccagcactttgggaggccgaggcaggcggatcatgaggtcaggagatcgagaccagcctgaccagcatagtgaaaccctgtctctactgaaaatacaaaaaaattagccgggactggtggcgggcgcctgtaatctcagctacttgggaggctgaagcaggagaattgcttgaacttgggaggcggaggttgcagtgagccaagattgcaccactgcactccagcctgggcaacagtgcgagactccgtcttaaaacaaacaaatgaaaaaaccattttctctcctccaagcaagcctaaggccacatgtcctattctcacacaggtgctttaatttcagcccagtctctagagcctaaatttggctcctctgcaatttccatgggctctaggtttccagcttatacttactgctttggctgtggtttctctcttccatttctaccacgtgaggatttccttttattttgtttaaagacagcacacattaaaaaaaacttttgttgttatcgtttacccaacatttctatgtttttttttcatgggaaggccatctgccataatgctagaagtcctgaacttgttttgatatgtgaccctgagccttcccggggtgctggcagaatggtgacatgattagatctgttcttaggaagatatcaggggcagcagcatttgggtagaggtagcatcctgaaggcaaggagacaggttaaagaaagaccagaggtgtcttttgacccaggtagacactactgacacattggtctgcgcaaacagttcaccacagctgccctttcatgccataggctcgatttttcctgttctcttggcaatccctctggttcagccaggacagtagcctcctctctgacaccaagatggaccatgctcttccccagctccaaatgtgtgctccttgatggaatagacacagtggacaagaggaccctcaggtggctttgagtatttgcctcaagcccatcatccctgaaggcagatgtgcttgatcttaacagagcccaggaagtctcccctcagatacaattttggaaaaaggacaatgaaaacaaaaagtcataactgtctaggttctttgcattttgaacaaagaattggacaaaaagcacaaacaaagcaacaaaagaaaagcacagatttattgaaacaaaagtacgcgacacagagtgggagggggctcgagcaagcagctcaagagctttggttacagaattttctggggtttaaataccctctagaggttttccattggttacttggtttacaccctatgtaaatgaaatagtggcccacgatcagtctgattgattgcagaaagcaactaatcagaggctgaagtgaagatacaaagttacaccctatgcaaatgtctgattgattgcagaaagtgaccaatcagaggctgaagtgaacttacaaagttatactcctctgcaaatgaagacttggcctgtgaccagcctgactggttgcaggaggggaccaatcagaggtactttcagttttcatctgcaatgcaggggaagttggggggttgcaaagggagtagcctctgatccttttgttatttgggtgtggagaggtgggcttttctttttgattcagttctaggaattcggcgcgaatcagccttaggttccctgcctccagaccctactctcctgcctcaatagccatgcccagttagtgttaactgtaactccctgctggtctgcctcctgctaggagggactgaacatcaaatcactcgcatcgaattactcagcaggtgagttctggggatgataaccacacaattctctctgcacgaaagatgggtttgagagcctcagagtctgggggaagctctgccagccatccacttactggcttactgtttgcctgaagtaagcatgggaatcccacagggtacaaggtcccgcatacccttctgggatttccgatgccctctttgcatgtgctctggtccatcaagctcccatgccagatgcagtgcttgtagttgcagcagtgaccatagcagtggcaacagttctacagggtcacagaactttagggaagcctcctaacacccctgctcttcgttaggctgcagctgctttcctgtccatgatttaagcatccttagatcccagctgtccaggaagctctccccacgcacctcagcctaagtccagcctcccactgagctcccatggcatgactgtccaggccccagcgcccttgtgccctaaccggggctgttccatgttgatatgtggtctcctcaggcatggtgtacactactagagaggaggggccaagtcttccatccttctgaccctcttcaaagcctggaacaaaattagatattgagagttgttcattaagtacctgagtgaataatgaataattgattaaagccagagaatcgggtatcacagtaaggagtccctgggtcctccgaactttccagaataaaattccaaaatgagaacaccaagaggttccctggcttgagagccaaaatggcggcacagacctatatctcaggcacactttgtggtaaaaacaagaagccagacacactctttctagacacacgtcacacccagaatgacttagcttttagtctgtggaggaaaaggggtggaaagtggagacctggaaccagatgagaagtcaacgggagcagtaagttcagtgtgtgcctcctgtcccagcacctgggtcaacatgggcaagacctgatggggtggtggagatgctgacctttgctgctgcctcttgggcctgtaagagcaaatacaatttaaaaaaaaatttttttttaatttttttttgagacagggtctctctctgtcactcaggctggagtgcagtggtgcgatcttggctcactgcagcattcacctcctgggctcaaatgatcctcccacctcagcctcctgagtaactgagactacgtggagtagccaccccactcggctcatttttaattttttgtagagacatggttttgccatgttgcccaggctggtctcagactcttggcctcaatgaatcctcctgccctggcctcccaaagtgtggggataacaggcatgagccactgcgcctagtctgcaaattcacattgaaagaagaggcctgtttgatagatcagtagggtgactataattaacattaatctaatatgcatttcaaaaaagctacaagagaataatttgaatgttccgctgcataaagaaaggataagtgtttaaggtgatggatattccagttgccgtgatttgattatattaatgttaccaaattattacatatacttcaaaagtatatacatctattatgtatcaactaaaaaaataagagttttaattctccttgtggaaaataagggaagagacttcacctccctcccttttcttagagattttactttaggaaacttcaacttttaagttctttcctctgtctctttgagatgtatgtaaatcttttaaaaagctaaataagggccaggtgagggggctcacgcttgttatccccagcgcttttggaggctgaggtaggaggactgtttgaggccaggagttcaaagttacagtgagccatgattgcatcactgcactccagctgggcagcaacaggggccctgtgctttaaaataataataaataataaatttaagaagctaaataagcctcttggcagctttaggacttagaaatatctttttcaaggaccaaggagccaaccttttgaaacgtagtcatcaagagtttcaatgggagggtaggagcctgacctggcaggtgcctcgctctaagttgcaaaactacctcctgtcctaaagctatgagaggtttgtttttcctttgaataaagccaattagctaacatagatggtgacatcagttaccaggtgaatctgtggtaaactctgtgcaacaaatggggctgtcaagtcctcttacttgaggactgactagctattgtctatgtggagaacctgtctggaataggtcacctctgcatgactctataaaagggtgaggtctctttctgtctttgtagtctcttaggggattgtgtgggatgtgcattacattttagttgagtgcttattcactaatgaaacagttttctttctccactccctttgtggagagatttcctgggttggcagaggttgacttttaataatattttctccacaggcccatcgtcccctgactctgtgagctttcagccacacccaggatcagtcagatcaactgctcaactcaaaggcatcctagtgagcaagggaaaactcaaggtggtttttggagggtgcttagttaggaaatgatgaacacagttcaacatgacttgcggccctccccatgggcaagagtatgaacacctgtgactgttcctgaactcactaaggaaagtcttttacagtgtgtgaagggtgacctggagtttccttcccacatggctcataagagcagcagctcaggaaaaacaaaacaagtatttatttatttatttatttatttatttatttatttatttatttttagagacgggttctcactctgtcacccaggctggagtgcagtggcacaatcatggctcactgcagcctcaacttcgtgggcaccagtgatcttcccatgtcagccttctgactggctgggactacaggcatgccccccatgtctggttattttttaaaaatttttattagaaggccaggcgtggtggctcccgcatgtaatcccagcactttgggaggccaaggtgggaggatcacctgaggttgggagtttgagaccagcctgaccaacatggagacacctcgtctctactaaagaaaaaaaaaatattagctgggcatggtggcgcatgcctgtaatcctagctactcgggaggctgaggtaggagaattgtttgaacctgggaggtggaggttgtggtgagccgagatagtgccattgcactctagcctgggcaacaagaacagaactccatcttagaaaaaaaatgtttttattagagacaagttcttgctttttgcccaggctgcttttgaactcctgggctcaagtgatcctcctgccttggcctcccaaagtgctgggattacaggggtgagccaccatgcctggccacaaaacaattttagaaaagaaaaaagccttttattttcacttaattgtcttgatttccactcctctgagacattcacccccaggaaacttggctgtgtagctatagatgataagtatttttaaattctccttgagaaatggcattattctgccttagatctcgaactagaacctgacaatgagtcctcctgcttgcccctgatctggggcacactgatatttttgcaggttccttcaagcatgaaattgcaaacctaaacaaactggttctcataaaagcacttccaatccttcaaataaaaggaggcagcctaattataaataatctctggattagaaacatcacacaccacatctcttgcaatttttattttacctcgtctttgaattccatgaacttcaatttcatgtggtgttaagtgctggcttaacctggagagaaaatataaaggatataaagaaatgtatataaagatttctcagagttataaaaatacttctgtgagagaattgctacaaaaagggagatgcaagaccaccctttgtccaaactggcattgtctaaatgcagttgagtgtcttgccttagagtctgggcttgaagtcagtcagaactgactagaacaccagccctacccctcaccaatagggtacccttgggccaattatttaacccttctaagccgtaactacctcatccgcagaatggaaatgatgctaggaagtacctgacaaggttcttgtgagaattaagtgagatcctgtgttcatctagtcaacttgtatttctttatttttaattgtattatacatttttagagatgggggtcttgctctgttgtcctggttggagtgcagtggtgtgatcacagttcactgtattctcaaactcttgggcccaagggatcctctggcctcagcctcctgagtagctgggacaacaggtatgggccaccatgcctggctaattaagatttttaaaaaatagaaatgggggtctcaccatcttgcccaggttggtctccacctcctgggctcaagtgatcctcctgcatcggcctcccaaagtgctaggattacaggcatgagccactgtgccaggccttgactcgtgtttcttgagcaaatcactgagctatgtttaaaagatacacagatgaaggacatataaacccagtccctgcccttaacttacagccgagctttcaataagggagagctattaatattaagtcccactgatggatgttaaaatgtaaatgaagcatagagttcttagggcctaggctcttcttgatgttcccttccaccatccttggaactctccagaacgagacttgttttgggggaaggagggtgccttggctgatggaaagtgcgggggtgggggccgaaggaagtgcagggcctaagactgttgttcttaagcattctggaggctgctggacatttagctcccagcctcctctctaccacaatgaacacttctatcccaggacttctcctctccccctccttagaccaaagctcttgcagtctgagtactggaaagcccagcatgagcctctccacgcacttcgaatgcaccctcctccagcaaaggctggtaagttgaaaagacaggaaggatttcagaagactggaaattgaatcccacactcagctcctctttgaaactctacaatgagtgcttcattccttggacttcagcttttcaaagaaaacatccctagaagaaggacagcagggatagtcatttaccttttaatgagaatgaattatccagcccttttcaggacagcgtttgtgaggcagcaaagctaaatgttgagaagggcctgaaagaatgatggactgacgctgccaaaaagagaaagggcgggaccttcacagctttgcctaaggccattatgaatttggaccaaataggtattatcatccacacaggcaggacctcctgggtagggggctgccaccttttccaggcacttggaagggtggcctccagctgtggagccacagaactaaatattatagctggcccaggagcacccgtttaggctagggaaggaataataatccggcttctccttcctctgaccctgagatttcggccaagtctccattagagattggcctcctagagtgtaaaacagggtggacaagtttggagaatggatctgggatggggtggggaatggcaaatggaaaaaaggcagcacaaactctttattgtcattcagagaatgctgaggtccaaggcacaaccagccagagggttgcttcagcctttcactggaaaagccacattttcctcagttgtatcctcacttcgagtgaggcttctccaaatgcagaaggacagcatcatgacccaggccgagaaagtatgattgcaaaattccatgggcctaaccctagtgggggagggaatccattcttttaagccagggtttaaaactcttcaagcaagtcatctgcaaaggtaccgcttctaccattttaaagataggattatgttccctaggacaactggatgagccctaggaaccaagaaccctgtgcagctggggcagaagcctgagggttcctttgttcccccacagctgtaggtcacaaggttcttacacaagctttggggtggccccaccccacacccttccttcccctcagtcagtgatgactcaagaggttttgggaaggagctcagggaacactcaagcagcaggctcagcttacggcacttctgatgcattttctagataacattagttgctggttccagacaggactcagaagtatggacattcactccccaggcttggtcatcagtgccctgtgagttcaggaatacactacctaaaggagatctttaggaaggagaaggagaaaagaggagaagagggaaggaaggaaggcaggaaggaaggaagggagggagggagggagggagggaaagagaaagagggaaggagagagtgaggaaggaaggaaggagagagaaagaagaaagaaagaaatagagaaagcaagaaaaggaaagaaaaagagaaagaaagaaagagagaatggaaggaagggaggaaagaaggaagggaggaaggaaggaagggagggagggagggagctggccggacgtggtggctcatgtctgcaatcccagcactttgggaggccgaggcaggtggatcacctgcagtcaggaattcaagaccagcctggtctacatggcgaaaccctgtgtctactaaaaaaataaaattagctggacgtggtggcagatgcctataattccacttacttgggaagctgaggccagagaatggcctgaacccgggaggcggaggttgtggtgagccaagctcgcgctactgcactccatcctgggcgacagggcgagacttcatctcaaaaaaaaaaaaaaagaaaagaaaagaaagaagagagaaagaggaaaaagaagaaagaaagaaaaagaaaggaagaaaaagagagtcattgagacttgtggcttaatgttgtgaatgtatatgtatgtttaactgtatatataaccgtatgtatatgtatgtctcaccagagagagaaagggattaaaaaaaaaaaaaagccaaaacctacaaaggcaaagcagaagaaagagtaccagactggagatagcaatataattacagaaaatgggaagtgaccgcacagaccagagaaatcagaaacctacatctgccgggggttggggtgtgtgtgtgtgtgtagcctcaaggatttactccgtgccagccactgatctaagggttgaaggtatattcactttcgcgatcccccaaaaatgctagcaggatttgtaccctaatattggagactaggcacagaaaggtttaatttgccccaggttacacagcagaatctgaacctctccgaggttcggctctagagaccacgcttgacacagcctcacagtcatgagtaagcccttagggaccaaaccccaggagacctcaggctggcagatcaggagcaccgaagtgggcctggaaacaggactgggggaaagtctggaggaaaagagaccctcggaatccttccccattttacttaggcaggcagctgccctctgctcccgggcagaaggctgtgggtttctttaggaggctttccccagttgaggatggggtgagacacctattaaaacaagagaatttaggccggacgtggtggctcatgcctgtaatcccagcactttgggaggctgaggcgggagaatcatttgagcccaggagtttgtgaccagtctggcaacatagggagaccctgtctctaaaaaaaaaataaaattagctgagtgtggtggcgggcacctgtggtcccagctacttggggctggggcttaggtagggaggatcacttgagcctgggaggttgaggctgcagtgagccgagatcacgccactgcactccagcctaggtgacagagccagatactgtctaaaaaaaaaaaagaaagaaaacaagagaattcagtgaaaatctgaattcagctcccatgtgttggcagtgaggcccacacaccccaggcgggggctgggagctcctctccaggagtgctgattggctggggagaagactgacggcactagcatccgaaggtccctgctggaattgctggttcaccaactgacgagtcctggccacatacacggggctcacacaaccttctgtcagctttttgttaccttccccttttttcctacacttttattatggaaaaatgtaaacatacagaaaaacaacacaaagagtacaatgtgcccactccctctgttctgcagttgttagcaccttaccatatttatctttagatatgtgtgtgttgtgtatgttgtttttcttttccttttttttttttttttgagacacagtctcactctgttgcccaggctggagagcagtggcacaatctcgagtcaccacaacctgcacctcctgggttcaagtgattctcctgcctcagcctcctgagtagctgggattacaggcatgcactactaggcccggctgatttttgtatttttggtagagatggggttttgccatgttggccaggctagtctcgaactcccaacctcaggtgatccacctgccttggtctctcaaagtgctgggattataggcatgagccaccacgcgcagctgtgtatattgtttttctgaaccatttgaaaatgagctgcagccataatattttcccatacatatttcagtatctatcttcacagaataaggacattatcacacataactaaatccatgacacacccaagaaaatttaacacaattttctaatgttgtctcatgttgaatccgtattctagcctcctgcattggccctagaatgtcttttccatgtgcacacattgcatttggctcttatgtctctttattctccttactagaatattcccaacctcttgttttccccacaatgctgactttttgagtaggccaggccatttagtggaaggagcatctcatatctgatttgtctgattgtttccttgtaccgtcatttaacttgtacctctatctcttgtaaatcccataaactggaagtgagatctaaagtcttgactagattcagatcagacacctttgacaagacacagagctcaagtttttgttttttttttgtttttttttgagatggagtctccctctgtcacctaggctggagtgcagtggtgctatctcagctcactgcaagctccgcctcccgggttcaagcaattcttctgcctcagcctcccaagtagctgggactacaggtgcgtgccaccacgcctggttaattttttgtatttttagtagaggcggggtttcaccgtgttagccaggatggtctcgatctcctgaccttgtgatctgcctgcctcagcctcccaaagtgctgggattacaggcatgagccactgcgcccggctgacacagagctgaagttctatccttcatgtcgcattgtatctggagacagcgtctgcataggtcactagcagtgaagcgaagtttgatcacttggtggaggcagtgactgctggatctttccactgtaaaggcacacgtttcccttcgccaatgaccttcgggtaacacacccgggcacagtgtgaatatcctgcgcaatgccttactcagatatggacaataaaggatgacaggaaacggagaaaaagctttcaacatgaaagagtgagacagaaacaaacaggaaaaagctttcaacatgaaagagggagacagaaacaaacaggaaaaagccgactcagaggaaagagagaccatcgcaggaagcaaaagaaaacttcccctaaacaataaatagccttaaaagtgagaatatatattacattcataattgacaagattgctatgaaaaaaatatttatttatttattttgagacaaggtcttgctctgtcacccaggggagtgcagtggcatgatcatggctcactgcagcctcaagtgcctgggctcaagcaatcctcctgcctcggcctcccaagtagctggaactacaggtgtgcatcaccacacccagctaattaaaaaacaatttttttgtagagatgggctctcgctgtgttgcccaggttggtcttgaattcctggcctcaagtgattctcccacctcagtctctcaaagtgctggaattacaggtatgagccactgcacctggccaaaaaaaaatttcaaaaacaagatagtgctcttgggctccacactgaaaaatccactgcaaaattggaaggtaaagtacaaacaaaaatttcttataaagtagaacaaaaagatgaaaaatagaaactgaggccaggtgcagtggctcacacctgtaatcccagcattttgggaggccaaggcaagcggatcatgaggtcaggagttcaagaccagcctggccaacatggtgaaacctcatctctactaaaaatacaaaaattagctgggcgtggtggcacgagcctgtaatcccacctacttgggaggctgaggcatgagaattgcttgaaactggaaggcagaggttgcggtgagccgagatcgtgccactgcactctagcctgggtgaaagagcaaaacaccatctaaagaaaaaaaaaaaaaaagaaaagaaagaaaaatagaaactgaaaacacaggaaaactaaacaattagtccaaaagtttagcatcagaatcatggcagttccagaaagacaaaagagaaaaagtagagggcgtgaattatcagagaaataaagcaagaacaggccaggtgctgtggctcatgcctgtaattccagcactttgggaagctggcggggagcggatcacttgatcctaggagtttgagactagcctgggcaacatagtgagaccccatttctaccaaaaataaaaaagcaaaattagctgggcatggtggcttgtgcttgtagtcccagcaattcaggaggctaggaggtggaggctgcagtgagccagccatgttcatgccactgccctccagcctgggcgacagagtgagactctgtctcacaaaaaaaaaaaaaaaaaaaaaaaaagaggaagaaataaagaaagaatgaaactatagtatatgagatgatgggtatgttaatttgcgtgactctagtaatcagttcactatatacatcaagataagtatatcaaaatattagtttgtgtaccttgaatatatgatatatttaaatataaaattacatacaatttaaaaaataccttttaaaaaacaaacacaaaagcacaatattgtgaactttctgaacatcataaaagaggaaaacagttcacatacaaaagatcaggaatcagaatggcattaaactttttaacagcaacactaaaatctaaaggataatggagccagggccgggcgcagtggctcatgcctgtaattccagcactttgggaggccgaggtaggtggatcacctgaggtcaggagttggagactagcctggccaacatggtaaaaccccattcttacccaaaatacaaaaatcagccgggtgtggtggcacatgcttgtaatcccagctacttgggaggctgaggcaggagaatcggcttgaacccgagaggcagaggtcgcagtgagctgagattgcaccattgcactccagcctgggcaacagagcaagactccgcctcaaaaaagaaaaaaaaaaaaaagaggataatggagccaggtgccatggctcacgcctgtaatcacagcactttgggaggctgaggcagaaggaacactcgaggccaggagtttgagaccaacttgggcaacaaagcgagaccttgtctctacaaaaaataaaataattagccaggcctggtgtcatgcacctacgtagtcccagctacttgggaggctgaggcaggaggatggcttgagctcaggagtttgaggctgcagtgaactatgatggtgccactgcactccaaactgggtgacagagtgagaccctatctctaaaacaataaataaatggggccgagtgcagtggctcacgcctgtaatcccagcactttgggaggccaaggcgggcggatcacgaggtcaggagatcgagaccatcctggctaacacagtgaaaccccgtccctactaaaaatacaaaaaagtagccgggcgtggtggcaggtgcctgtagtcccagctactctggaggctgaggcaggagaatggcgtgaacctgggaggcggagcttgcagtgagccgagatcgcaccactgcactccagcctgggcgacagagtgagactctgtctcaaaaaataaaaaataaaaaataaaaataaataaataaataaataaataaataaatgataatggagcaaagccttctaatttccgagggcaatttgaacaacaaaattgtccagtgacccataggataaaataaatgagtcagtgctaataaaaataaataattgaatgactaaataaatggagaagaaatagctctaccctacaagagaattccaattaataaatgtaaaagaaatgaggaaaaaagaaaatcactattagaacactacagtaataattgttgcaggcaagattcatcaatgaatgctataattagttggtaaaagtttgaggattaacaggatatttacatagtctcaaagtatgtccactaatatatttattatctgcaaaaggaaaaaactttatgatggagaaactagcagaaaccactttcaccacatgatcaaggttagcatcaccagtaataagtctgatcaacatcaagcacccaacacgatgtactgagaagggcacgttacctccatggtattcttgccccaaacccataactgtctaatcatgaggaaaacatcaaacaaatccaaattgagggacattccaaaaaaataactgaccagtctttttcaaaactgtcaaagtcatgaaagacaaagaaagactgcctaggacaggaagagactgagaagacttagcaaccaaagcaaagtggaatctcagattggatcatggaaaaatcaaacgacattggaaacattggttatatctgaagtctgtagtttagtaagtagtagcgtaccaaagttattttcttagttttgatcattgtactatggctatgtgagctgcataaagacattacatagaactctgcagtgtctttgcagcttttctgtaagtccaaaattatttaaaaatagaaagtaaaaattcagaagaggaattatttccaacctagaattttatacctaaactataaatcaattgtgagcatagcataatgacatttctcagacatgcaagggctcattcactttctgttaggaagcgactatagttttgctcccttaaaagaatgaaccaagatgcagacatggcatctaggcaacgtggaattcaacactagagggaagcaaaggtatttccagaactgtggctaagcagaggcttccagaacaaccagtatagatgggagcaaggggactaattgttcctagaggaaggatgttgcaaaccaaccagctaaccaaccaatcaccaccaacagtttacctatctatttgattatatcggggaagttttccgttttggcagagtgtgggattgaattattgataagtatgcagaaaactaagcaaacagaaaaaaaaaaaagacaatgatcagctcttgggaaaacaaaatgttgccctgaaaagaaatgtaatcatagtatcctaaatgactcacttgtggataatttttccatagtcacgataatgtaaatactaaatactcatttaactaaatatttatattgggaggagggaagaagggaaatatgtgtgtgagtggagtatagggataagaattaaattcttgttttcaaaggtgagaagcaagaaaatctctgtccaatgggctcccagccccaaggcaagctgcacattttaggtatcatctgggtgggaatagtgagggtggtgtggcagatgtgaacacacaggggaatcctctcttctgctgtcctaggcaaactggtggctagtggaaggaagccaaggctgagtgggattagggctaggaagatgggccaggctgtgctggctcgtgatgcaatgacctcaggttctatttcagcagggttcagcatctaaggagatgccatctagggtggagtgcagccacaagtcaaagcagctgatagctgtcacgaggtggctgtggcctggtttgggccttgttttcaaggtaggttctgtgaaacactacttctgaaggatgtaaagaactgacctgaaaagagggttccttggtccaacatgcttgagaaatgctggattcaatgacactaaacaagtttctccaatgcaggacatctcaaaacccttcatatgattatgggaatatccaatctctaaggcatggcatgtgggggagatggtgacagagtgtttgatcatgaccatggaaccctttctatgcagaacttaacactggactagagaactactgacaaccctttccagagtaggggtcggcgtcagtcagggccggcactaacaggaaaagcacctggttccttgtatcttcacatctttaccatcactgccaacccctttccactggctagggctaattagggttttggggccaacaggcaaatgaactgaggtttgagacaggctctgctctcatgaaaaactgaagtgttaacaagacagaaatgtaggcagaggcccagttataaggtacagaggcacccagcaggggtgggactcagtggcccccagacctgtagcatgctgacaggcccacgcaaagccaagatcaaacctacagcagcccttctccatcagcccagcaccctgagtcgcattccttggtcaggctctggaaatggtagaggcagctgctgtgggaaggtgaaccccgggggttctggcccagcttgtttggggcaaatgcaggagctgacaacttacaatcacagcctgtccccactcacctgctacagaggactcagtcatttcatttccctgatttctccaggtctctagtgggggttccctggtgccgacaccattccatccaggagctgatgaaaacccctcttctctgaagcacaggcagaatgtatccttagaaaggaagccagggggccgggtatggtggctcacgcctgtaatcccagcactttgggaggctgagatgggtggatcacctgagatcgggagtccaagaccagcctggccaacatggtgaaaccccatctctactaaaaatacaaaaattagccaggcatcatggcgtgcacctataatcccagctactcgggaggctgaggcaggagaatcacttgaacccgggaggtggggattgcagtgagccgaggttgtgccactgtactccagcctgggtgacacagggagattccatctcaaaaaagagagaaagaaagaaagaaagaaagaaaacacagggttgctaaggccaaggcatcacacacttaacaccaccaagtcattccagagtgaaaggaacgcaaatccagtctcaggctgtctgattgacgaagcttctggatgcacagcttttacatttttatattttattctctgtgatgtgcccagctcaggagccgcaggtttcggccagttgttctgctctagtcctgagcgccctggcatgttttacagttctgagactgtcctatattcagggcctgtaccatggacagatgcaaagccactaaatgtgtgagctggaatagacaagaacagttatattgagtgtttactacatgctcgtcctcacaacgttacgtgctaagcactaggagtcgcagtttttggggtgcagaggctgaggatgagggcagttacatatcttgtcaagtctccccctggcaaggggcagttgtaactcagcacttcctggtggcacagcctgggctctgggctccccccccaacgcttcgcaggtggcctggctgccactgttccccatggcactgggcaggccgctcaccttttgttgttgccaggctcttcgataatccctgtccatggggttcatgagattatagcgaggatcagataatgcagtgagcagaaaagtgctttggagtggagtgaatacacacatggggtgccaatcacagccagtccttttcctagctacccaacaatttggcatcccaaagggatcaccctctctagcgcgtgtttatgagctgactagaaaaaggcacgtagacgcaagaagacagaagtgtgattttgaaagtgggtacccctttacccagagctggaaggcatgaaggaggtaagggtggagacccaccgtctagaggctttgaactgaaaccttggaagagtgaactctctcagacctcatggctgcccccaccccctcccaacccttcccctaaaggctttagacactaaaaataccccagccacctgctgccctgggaggcaataaatcattggccatctagcaccagaatccgggccaacatggcagcggacacagacccaagggatcagttcccttcctcccacccaggccaccatcaagagcctgcctgctgctgggggtgggggggggggggcaggggggtgggggggggcggggcaggggggcgagggagtgtgttcagaggacacaggacctgcttggaggcttctggggccagaagtgctaagtgggtgtggggtaagcggaagggagtgagtcactggagggggtcctggggaaagggcggtggcccctgtgccgcgacagccacctgctttattatatagaataaggtcatctcatcaaaaccacagctgagccgcccaacgactgtcctactactccagggccaccagatgtcagtgttaaagggatcatggatattggtgatcagatgtcaggacagggactgaatgtatggagactgttcaaaccaggggcgctcaggggcaaacctgtgaaatcggtttcctgcttccagttcttagcaattagatcctacccccagggactgaaatcagtcccactcccaaaaggtaaccacaaaatgccaaagatctgttcatcttcactctcagcacaataccatgtatcataaatgagaggcaaaggcagaatttctaatttacttattattaaaatgcatcatcaacaaacacaccatagtggggaacacgaagcgatgtgttgcagtgtagtgttgctcaaatgtgaaaaagcagcgacccctgagagtctcctttgttttgttacctctctctctagaaaaagcactgcattgtaagtgacttggtccaaccagtgaaaaatacaaacaggaccattcatagacaaaaaagtgaagaataaaattcagtggtcactcaagtataataaatagacccaaatgatcagaaatgtgtttatgttgattgttttagagcattaaaaaatccaaaaatttgggaggctaaggtgggtggattgcttgagcctaggagtttgagaccagcttacacaacatagtgagaccccatctctacataaaattaaaaaattagccaggtatggtggcatatgtctcaactactcaggaggctgtggtgggaggatcccttgagcctgggattgaggctgcagtgagctgtgattgcaacactgcccttcagcctgggcaacatagtgagatcctgtctcaaaaaaaatgctatgtggccttggggaggtaatctgacccatgtgcctcagtttctatgtctataaactggacctctccaaagcccctttaagtaatgtaagattctaggattctaagtgtgactttgagaggttcctgtggagttgggaaggtgaatgtacaaaaattccaacggaatgccacccagggccacttcagcaacatagacaaagactgagaattcagaatgcctccctcccaactcctcagggacccagggaaggcttctggaagacaagggattacacccctatgacctaatgctgtagcatgatcaaaatacttgatctctttttaagagctgggaggtggccagtcagatattttaagatgtcaacttgatctgtatcattatcagcatctaaggaaacattttgtttccaaaaacaaatgatcactgctatctataaacctctgtaagcacatgaaattctcaagaatggggccttttccgtaatactcttcacagctggttttgtgtgtacacgtagaactgctgcttcctgaacgataagtttaggccaaggaagaaagaggggaagaaggaagggggagaaagtctttcttcaggagtctccccaaaatgttaatatatgcacagaaaaaagtttgaaaaatagaaacaatggcaaggagcagtggctcacacctgtcatcccagcactttgggaggcctattgcttgaacccaggggtttgagaccagcttgggcaacatgatgaagccctgtctatataaaaaaatacaaaaattagccgggcttgatggtgcttgcctgtcgtcccaggtacttgggaggctgaggtgggagggtcacttgagcccaggaggttgaggtggcagtgagccgataccatgccactgcactccagcctgggtgacagagtgagaccctgtctcaaaaaaaaaaaaaaaaagaaagaaaagaaaaaaaagaaactaactttgtaacaggtaactgtggttctgtctgatgatactggaggtaatcattattattttttgcttatctgaatttttcatttttcagcaaagaacatgtcaatttgcgtaataattttttttaatgcaaatacatgcaggaagggtaatacatcaaatcattatccgttactaactccttgatgttagtgaatgggtgtgatttgtttcctacactggtaagaagtggattttgttaggtctggggtctgcagatctcaaggtggcacttaaggcagtagaaagggaagagagaaggtggagaaccctcaaaagggaagtgggtggagaaggttggctcacaccttaggcccgccagctgctgcctgtaaccttgagggcatttatttatttttatttaaaaaattatttatttttagtttttgtagcaatggggtcccactgtgttgcccaggctggtcttgaacttccagcctcatgtgatcctcctgccttggcctcccaaagtgctgggataacaagtgtgaaccactgctcctgaccagagggcatttaataacaattaaggataataacagttaaccttttctcatgcaaggctttgcccaattattctctttataaataacttctctttagagtcaaactcaagtgttcataacaaacaagaaaaacagcacatggattttaataactttaaaataatgaaaaacaaatgattcttctccaaactttttcattttgatttccatcaaaactttgagaaggttttcttttacaatttccgtattggaatctatagacttttcttgaagctccagtgtaaatacttcaggagttatagagctcgcataattaaatacaagcaaacatcatcatttaaacacttttaaataggttatgctgacttttgccccaatattttctagaaaggaagagtttgcaaaggaaatttacagtataaacaacactggggaggtatcttagtccattttgtgctgctgtaacagaaaatctgggtctggataatttataaaacacagatttatctggctcatggttctcaaggctggaagttcaagattgagggactgtgtctggtgagggagttctgctgtgtcatctcatggcagaagggtggaaaggcaaaagggcacaagcatgagagagagagagagagagagactgaaagagagacagaaagagggagccaaactcatccttttatcaggaagttgctctgctgtgataactaacccgctcagcattaatggcattaatccattcatgagagcacagccctcatgacctaatcacctcttaaaggtcctacctctcaacactgttgcaccagggattaagtgtctgatacatcttttttgggagacacattcaaaccacagcaggaaggatggattctttgcatgaatcactccctacaatataagctattcaaaacccattgcgaatcattttatatattcatgaaagcatgccttctatggctggctccctggcaacaaatgtgatgggcagaggatagaaggtaccagagtaacagatctctaaatgtcgaaggcaaaatgtagacttttaaaataaactctaccaggtgcagtggctcatgcctgtaattccagcactttgggaggccaaggcgggaagactgccagaacccacaagtttgagaccagcttgggcaacattagaccccatttctaccaaaaaaaaaaaaaaaaaaaaaaaaaaaagccaggtgtggtggctgtgcctgtggttccagctacttgggaagctgaggtgggaggattgcttgagcctggaagtcgaagctgcaatgagttgtgattgtgccactgcactccagcctgaggtgacagagagagaccctgtctcaaaagaaaaaaaaaagaaggaaaataaattccaattgtttatcaagtagttggagatattgaggcttgaagagggaagcaatattgaggcagtgccttgttcattgaatctaagaggccgtcaagcgtaagatgtactgtactttggacagaaaaaactggcagggtgtggtggctcacacctgtaatcccacactttgggaggctgaggcaggcagattgcttgcccaggagttcaagaccagcctgggcaacatggcaaaaccctgtctcatcaaaacaaacaaacaaacaaagaaaaacccaaaatgacaaaaattagctgggcgtagtggtgcatacctgtggtcccagcaactctggaggctgaggagggaggatcacttgagtctgggaggcaaagattgcagtttaagccaagatcaggccacggcactccagtgagccaagatcaagccactgccctcaagcctgggcaacagagcgagaccctgtctcaaaagaaaaaaaaaaaaaaaaagaaccactgccaactaaattatgacatataaactgcaaaatgcatcccaattttaaaaatgttaaaatgtgggggaaagtaccaccttggatcaatgaactacagcattcccccagtctgcttgctcccacctccttgtcagggtgtgacgggattctactcacagtgcctgtggctccttaactgctacacggggacaccaaccctcctcccagctcacttcactgtgaaggcatttagacgtgtccttacttggcagtagagtgggtctgtactccaagttcctgtcagagtataatccccatttctctcccatttgatactcagcaaaaactcaatggagagaaatcatgcttgcagtactgccggcaggattggcagcccatccattttgctctactctgtttacccttggattgagccagatcagcagagagcaaagccctggaaccacgctgggtaatccctcatgggaaggcctgcgcagacgctcctgctggcgggctgttggcccacgccagggaggctgttagaaacaggccgagttgtcctgaatttgctgtcaaggacacagcaatgggtcttcatgaggaccactggagacatttttcacgtcttcataccagaaatttaaaaaaataaataaaattttaagaaatggaggatatgatcactacgcattacatacatgcagcaaattttctcatgtatcccataaatgtgcacaaattaaataaatatgaaggtgtttttcttaatgcagttgttataatcataaaaagttgtgcatggatgatgtattagtccactgtcacattgctacaagtaactacccgagactgggtaatttataagaaaagaggtttaattggctcagggttctacaggctgtataggaggcatggctgggggaagcctcaggaaacttacaatcatggcggaaggcaaggtgaagccggcacttcctacatgggcggagcaagaggaagagagcgcgaaagggacatcgctacacactttacaacagatctcgtgagagctctatcatgggacagcactaggggaatggtgctaaaccatgagaaaccacccccatgatccagtcacctcccaccaggcccctcttccaacactgggacctacaattcaacatgggatctgggtggggacacagaaccatattaggtgatgtaaaattcacttccttacaaaggtttctgactatggttaaaacacatcagcctgagtttggcccatggggaagtaaagaataactactgataatgaaccaggaaatctgactgaataaattaccaaataaaatgatattatgaacaaaaataaaacacaccttgagcaacatagtgataccttgtttctattaaaaatttaaattacctgggcgtggtagcacatgcctatagtcccagctgcttgagaggctgaggtgggaggagagcttgagcctgagaggttgaggctgcagtgagccatgatcttgccgctgcactccagtgacagagtgaaaccctgtctcaatataaataaaaaagtataacatatatacagaaaagtacataatttataaatgtacagccaaatatcacaaattataactaccccaaatgaaaaaaataggacattaccagaagcccctatgacttctccccatcactgcacccatcttgtcccccaaaggcaatttccatccggatttcttgatttttcattttttatttttggttttttatacagaaaggtctcactatattgcccaggctggccttgaactcctggactcaagcgatcctccctcctcaacctcccaaagtgctgggattacaagtgtgagccattgtgcctggccatcctgatttctaacaccatcgattagttttatgtttttaaactttacatcaataggatcaccgaacatgtattcttctggtctggctccttttgctcctcattatgtctgcaaaatttctccatgttgttatgagtagcagaaggttgttcattttttgagacaggatcttgctctgtcgcccaggctggagtgcagtggggtaatcacggctcactgcagccttgacttcccaggctcaggcaatcctccccactcagcgtcctgagtagctgggaccagaggcgccaccaaacctagctattttttttttttcatttgtggtgtgagggtctcactatgctgctcaaggctagtcttgaactcctgggctcaagtgatcctcccgccttggcctcccaaagtattgggattacaggcatgagccatcatgcctagctggttgttggttttcattgctgtacagtaatccatttacgtataacttattcatttagattgtttccaatttgggattattatgaataatgctgccattctggtgcatatattaagcatttctgtgaggtacatacctaggagtcaaactgccgggttacaggatatagatgcttggctaagctcttgggggtgactacgggatgaccacagaatggaccacccccaagggcagcactaccagtgaggccaccactggggctactcagaccacagacctgctgctcccgccatgactgcctcttgatacccagggagttggacacttggtatagtaatgccaaactctcacatttccatgaccttacttgtctgcacaaaacagaaaagagggagagagacagagagagagggagggaagaagacaggagagagagagggagacagagagagagagaaacagtagaaaatggcctctatattttcaccctccaaatctctcaagtacttctgaaaggtaaaaccaatttggcatctgggaccagggcctgcagcctctgcagggtaggaagccaacctagaaggagagtggaacacagactgagctatcagagctacagcatccgccacaacataccaagggcctggtctatgtgctgggcaaggcagagatcagatctgtgagctcaagagtctagtaagaaaggcaagcactgaacaagttaacgtaagtacctgctccccagccaccacagaactgctaattcatctcccagacgagtgttttctgaaacgcaatgtaatcacgagtccctcttggtgctgagggtaagtgccaaattggtgctttccttctctcaattctgtagaaggttagggcatacattttgcatatttatttcatgctcatcttatttctctctcactctccctgtgttcctatttcctgatttacttttcatcataatgtattatgtatttctgcaaggcatctccaatcttcctccttgaaaaaggacaaatataaatcaatcatctctctgcatggggccccagtgtttacccatttactcaggaggagtcagctcactcaccagctcctatttgggttcacaaactttaaatagtataaatataaaaacagaagctttcaattcatttctggtttcacattggtaaccaaaaaagactggtgagaagattaaaagatgaggcaagaacatttcctttggaataaaaaattaatataacactgcagtattctaagataattggttttactaatgtggaacaattaatgccagccataaaatgtataattaaacattttattattacaaattcaaatttgttctcttttccctatatcaccatttaattgaacaacaatacaacgaaaactggtcgccttaaaaccaatttgaaacaggttgttcaggagcaacaatacaaaaacaaagtgtagactggaatgtattacattttggccaaacaaaaagatttgattcattctggttcatgaagttagataatggtgtttatggttttgaaagttcactgaaacttcttcactgaactggtttctttctgatgcattttcttgagttctagccatgactgccacagtagcagtcctgggatcagaacccacacaccgttaaaaaaaaacaggtaaagccaacagtacagccagttgctggtgttgaggttggggcttctggtgagccactctgggaggaaggtcatccagcagccatacagctcgcacacgcacagggtgatctgcaggaaatgcctgttggagagaaagaagcccgggatgaaccaccagcttggcacagtttggcatcagagtcatgacatcttgtctgtaatggcggcatcaacagtcttcgctatgaaaaccgtcctaagttgggcctcagatgttgggtggtgctattttgatgggggcaagtcaatctaattaatgaaggctcattctttccttagaggagcaacactgccctttctagattattctcagagttaagtaaggaccctcagggatcctgacccattcttggggaaatttggtgagatcacacctgacttaacacagagaggcctgactctgaatctcaccatgagccattataaaaggggagagtgagtaataaccccttcctcaaacagtgtagtgcagactaaatgagatatgaggataaagggccaagcgatgggcaagtaaaaggctcaataatgcaaatatcacaaatgtttaaaataataaacacatgggcacacgtagtaagtttgcaaccagcgtcatggagtgaaaaatacgtcaaggtaccaaggaaaaatttaatttttattgccaactatctctctaaaattgggtggggaaggaagctttaaataagacttcttcattacaagatggtggaaaatggaatgcagctgtgcctacttgaaattgttttagggattcatctcaggatagcaatctattcaccccaggccactctgtccctaaggaaagaaaaggaaggaagggaggagagtttatagtctctgagtctgataggatggataattttttcatcctttttttttgagacagagtctcgctctgtcacctaggctggagtgcagtggcacgaacgtggctcactgcaacctccacttcccaggttcaagcaattctcctgcctcagcctcccgatagctgggacttacaggcacccgccaccgtgcctggctagctaatttttgtattttgagtagagacggggtttcaccatgttggccaggctggtcctgaacttctgatctcgtgatccacctgcctcggcctcccaaagtgctgggattataggcatgagccaccgcacctggtctctctgcactccgcctgccccatatccttcacaatctgcttctgagaagatttcctatttatcttgcaagtctgactccaaattatataagataatttactttttgtcaagtgggacaggagttttcttgaatgatttggggggaaaaggatggacgtattatggttttattctccaaagtattggtggcaaatcatccaagagcgttagcaccattcttgcctctacagagtctaggttgttattaaaataatatttctcatatttttgattctgaaaagtctgaaatgatcctagtagcaccatcacccttatctcacataaaataattttcatttctcttctgctttttttttttggagacagggtctatgtcacccaggttggagtgcagtggcgtgatcatggcttactgcagccttgacctcctaagcccaagtgatcctcccacctctgcctcttaagtatctgggactacaggcgtgtgccaccacgcctaatttttaaattttttattccttgtagagacagggtctcattgtattgcctaggctggtctcaaactcctgggatcaggtgatcctcccgcctcagcctcccaaagtgctgggattacaggtgggagccaccgcgcccagcctctattcttccaccttttatctaacaaatatatgtggtcacaacctactccaaaggtcacctaagtgttgggacatgtaatgtctcccctccttccagcaggacagaagaagggcacctaccggtaatatttttctttgactatggcataaatgaggaacaatgccagagacccatccagggcgacggtcagaatttccacagacacaatggttggatcaaaataaacccatcttgcatcagctttgccatattctttccctaaagacaaaatccatgttgttactcaaatggcaacaatttttatgacagttcatggaaatgacctttctttcctttaaggtggagataaaatgagtaatcgccactctctctgcattcttcacgatgccttagtggaaggcaggagaagccctgggaccaaaatgcgtttaccacctgacacaagcactgagaacagcagcaggtttacaggtgtccaatcattcagtttccagcatgctttcacatacacgccctcctcagccccaccctcttcaacataagtagcagaattttaaaagaattcaacatggtcagattttgcaaagacaatctccagtcatgatcttggtaaatacattgtaattccttacttcaaaatttccatataaattctgtaagtataatggagatgtgggaaatttgttatgaaggacatgtttataaaaaacacgtttatggccaggcacggtggctcacacctgtaatcccaacactttgggaggccaaggcgggcagatcacgaggtcaggagatcgagaccatcctggccaacatggtgaaaccctgtctctactaaaaatacaaaaaattagccaggcatggtggcgggcacctgcagtcccagctgaggcaggagaatggcatgaacccaggaggcggagcttgcagtgagccgagattgcgccactgcactccagcctgggtgacagagcgagactccgtctcaaaaaaaaaaaaacaaaaaaacaaacaaccaaaaacttgtttcttggccaggcacggtggctcacgcctgtaatcccagcactttgggaggccaaggtgggcggatcacttgaagtcaggagtttgggaccagctcagccaacatggcgaaaccgtgtctctactaaaaatacaaaaagtagctgggcgtggtggcgcatgcctgtaatctcagctacttgggaggctgaggcaagagaatcgcttgaacccaggaggcggaggttgcagtgaaccgagatcgcaccactgcactccggcctgggcaacaagagctagactctatctcaatacaacaacacgtttattaataacagaagagaaactaggtgctgaagggacagtgggcagggaggggaggagagagcccagactgcagaatgaatcggagtgggcagaggggcatctccgcccacagggacagggaactcacaatggctctcacacagtctcagctgtgctgcttggggagccagtgtgctctcagagatccatccagacccattatcagagtggtttcttctcaggaacaccatgactcagaaagtcttttcagggctggaatgatggccaggtattatggaggccattaaaaattatttaattactttcttaatttgtaaaagtaatacatgctggtcctaagatctcaaatgattacagtgaaaaaatggaagtgatcacacctcgtctccccctttaatactgcctcgcattattcagaaaaggtgtgaagtccacagaggagcctgtgatctgctactgagcagcacacagctcttgtctcataaagaccagaggaaggatccctcagggcctgggacaaaggtttctaacaaaaggctgtcctaagagaaaggacaataagaggattagctatttaatgggataacacacaaggcacatgctgagggaatgttctgtgagaggccaccgagagtcatcagcctgtccttagctgactgtctgcagtctcctgtgccctccaataactaactggaaaacaatgtcatattgaaacgtttctcctctaaatttaaatatacatacaataggtgaaatgtaccagttagtgcacctaaaatctaataaaatatcacctaagtaaaatgtcagttctttaggaacaaaaagagatattgaccaagtctttttttttttttttttgagaaggagtctcactgttacccagcctggagtgcaatggcatgatctcggctcactgcaacctctgcctcccaggttcaagtgattctccagcctcagcctcccaaatagctgggactacaggcacccaccaccacactcagctaatactgactgactgagacggagtctcactttgtcacccaggctggagtgcaatggccagatcttggctcgctgcaacctccgcctcccgtgttcaagcaattctcctgcctcagcctcccaagtagctaggattataggcactcaccaccatgcccggctaattttgtatttttaatagagatggggtttcaccatgttggtcaggctggtcttgaactcctgacctcaggtgatccacctgctttggcctcctaaagtgctgggattacaggcttgagtcactgcacctggcctaatttttgtatttttggtagagacagggtttcacaatgttggcaaggctggtctcaaacttaacctcaagtgatccatctgttttggcttcccaaaatgctgggattacaggcgtgggccaccgtgtccagccttcaacaagtctttttttttttttttaagcatttggaaggtgttatggtaggccctgataatgcagctgcaagtaggaccatgttggcccttagtggcccacatcctagtgaggctgaaaaccaggcagtaagtggcggttagcgaatatgagggcagggaagaagtggcactgaagccagactacgaacttcagggaagacttcctggaggaggtgttttgatcactgcctctcttccctgttggtgagggatggacttctgcctgagggctatggtgatggctgaacacacaagacccgacactgggcagatgagatggaggaggtttattagttgcacacactgtggcccgggaaaggaggacatctcgccatgcagggccacataggggttgcacctgggaacagtgttcgggcaggggccacgcaggcaggctttgcagtaacaagaggagggggtgggatgagccctggttccccacagaggatgtgattggcttgtctggataattccacaggcagactggtgggaactgaagcctgctactgaggggacaagcatttgtcccctccaaatctgtgcctgctccccttgatagggagagctatctggttagggaaccttatatgtggaagcagagtggggagggagacttgcagtttggccatctgaggcccccctggatcttaccaggtatcaaagcagacataatactgaatcccagccagggagggtggctcacacctgtaatcccagcattttgagaggccgaggcgggtggatcagttgaggtcaggagtttgagaccagcttggctaacatggtgaaaccctgtctctactaaaaatacaaaaaattagccaggcgtggtggtgggcgcctgtaatcccagctactcgggaggctgaggcaggagaatggcatgaacccaagaggcggagcttgcagtgagccgggatagcaccactgcagtccagcttgggcgaaagagtgagactccgtctcaaaaaaaaaaaaaaaaaaaaaaacaaaaattagctgggcgtggtggcgcacacctgtagttccagctacttgggaggctgaggcaagagcatcacttgaactgggaggcagaggttgcagtgaactgacattgcgccactgcactccagcctgggagacagagcgagactctgttaaaaaaaaaagaaaaaaaaaaaaggcagacataatactgaatcctaatttcaggccttataccacaagagatgactccagatctgagtggaaaataagggtgtttcagggaggagcatgtgcaaaggcctggagctgagaggtagcgtgtctgaatctacagacagtttagcagagctgatggtgggggaaggttaatgcgtgagaggaaggtaggggacggatagtaaggggccctggaatccaccagtcccagcgcatctccctgtggcatctccctctggcagtccctctggcatctcctctactgctaaactttaaccatctctttgcttattaaacactgaaacaataaaaaggcaaacaggagcattaaaaagcctgacgatgtgatcatttccattgattctgtgactgataactggacttaggtgaggtttacaaggaaaagatgcaaactaagggtcggggtagatttcctcaaccagagccattgttgtgtcctcaaccagacagtggagaccaggagatgctgagtattcatgaggtttatggctggccctgcatcccagtgaagccaaggtcagaacacaggtcatcatcagaaggtcctgccctagacacacggtatcagaatctgcatttgagtaagattcccaggtgatctggggcactttggagtctgggaagtactacttgctttacattatctactggatttttactttcatgaaaataaaggacaccttcaataaatgagtttttactgcgttttggtttttagaaatacggtcttactgtgttgccctggctaaattcaaactcctgggctcaaataatcctcctgcctcagcctcccaagtagctggggctccaggctcgtgccactgcacccagctagttttcacttctttaaggtgcataatgtaaacgtgaagatgatagagaaagcctgtgttagacatttgcatttcatgggattgagccaaatctgggctgtttgctttctctcatgccaggcagggcagccaggggaggaggtgtcagcatggcatctggcaaaggggagaagaggacactcagcagggaggagccatgactcaggctggggtccgtcagcctctgggcttcaccagcaatccccaggcagagtttaatgcagccaatcaaaagtgcatagctgcattcagctgagccctggatctgaagtggctctactctggtcaagggggctcaaactccttggctaggacttgaggcatcaaagatgacaccttttcctttgggaagtactaatgagcctactcaattctctagatgtttcctaacactagtggtaaacaggagtcccccacacagatcctagctggagatgattttagagtcacaaagaaatgagatatatgggccaggcgcggtggctcatgcctataaccccagcactttgggaggccgaggtgggcagatcacgaggtcaggagatcgagaccatcctggctaacatggtgaaaccccgtctctactaaaaatacaaaaaaattagctaggcgtggtggcgggcgcctgtagtcccagctactcgggaggctgaggcaggagaatggcgtgaacctgggaggcggagcttgcagtgagccgagatggtgccactgtgctccagcctgggggacagagcgagactcgcctgaaaaaaaaaagaaaaaaaagaaatgagataaatgatgcaaagtttcagaagcaaaacctgaaagcagttatcctgagaaaggcagttttataaagtggtaaaaaaaaatacctgttggtattgacacagtacatggtagaatatcaatgctaattgaatattgactgacaatgagcatgaagacttttggaaaggatctacaagaccacaaatatatatgtacaataaaaagaaagttgatattaaaagtatgggaaaaccacccagtttaaaccccacaagctcttccatctgcactcactaccaacattttttttttttttttgagagggagtcttgctctgtcacccagactggagtgcagtggcgtgatctcggctcactgcaagctccacctcctgggttcacgccattctcttgcctcagcctcccaagtacctgggactacaggggcccgccaccacgcccagccaattttttatatttttagcacagacaggatttcaccgtgttagccaggatagtctccatctcctgacctggtgatctacctgcctcagcctcccaaagtgctgggattacaggcgtgagccaccatgcccggccattcactaccaacattttttattttatgtattgttttttagagatggactcttgctctgtcgcccgggctggagtgcagtggtgcaactgtgactcaatgcagccttgaactcctgggctcaaaagattctcccgcctcagcctcctgagtagctgggactacaggtgtgcaccaccacacctggctcatttaaaaaactttttttaaagatagggtcttgctatgttgcccaggctcaaatattgtttaatataatagctttattaagatgtaattcacatgccacacaatctacctatttaaataattggttttagtagaatcacaggtttgaatcaccacaatctaattttagaacatttcattaccccaaaaagaaatccgtgcccattagcagtcactcctcatttccccccaacacccccacccctaccctcattcccacgcaaccagtaatctacagtatctctacagactcacctattctggacatttcatataaatgaagtcatacagtatataatagaggcgtttgacagtcacacttgcaataaacctcctccaacatttcaaacgcaaacgtttttaattacttacataaagaagcaatcaagccatcggaatttgcaacgtttcctactaaagacaagtagacaaaagggccttcctagagaggagaaaatgaagacatgctctaatacagcatcacaaccacaggatggcactgtagacacatggcattgcctggctccatcccccacccttctccatggctcacatcctggccacagcctggaaacatccatacaaccttgtgggatacaatcttgggacctggttacctggaccttggaaatgggtatgtctcaccctaatgtacaattaatgttgtttttcaatgattggcactgtaaaagcagagatgtgttcttatgtggaaaaagtgaaatttttgcataagagtttaactactgtattaaatagagtaagctctagattattccagggatcttaagtctttgcggagaaccccacagaagttcacttttttttaactcaaaaaaatctaagatcttaaagagaaaggcaatcaagtttataccagcattgagcaatcctccccccttctcctatataagggcaagtttaggaagatttaaaacagttacaggctacatttaacattcaggtaataaaatatctgcaattacagttagtattttcccatcactgaagtgcttctttgcctaagatttctaaaactaaacagctagaagccactgggatatgtaattgtcatgttgctcctttgaacaaattttgctgctggtcaataaaacttttttctcattccttttaaacaatcatttgtatgacattaaaactgggtcctgccaccccagaggtcaccactctcaatcacatctctttgcagttcccgcggtgatttcataatatacttacactgctatttccttcgactactagcaggaaaagctattgtttgattgatactccttcctctcccgtttccagtccttcgagtttctgatatattattctattacttacacaaatttgtaacttaagtaaaaaaactgaaaacctcagctcactcactcatcaattttgtgcagtctctgggcttctaaaccacgaaagagtatgacagcctctaccaggctccccgcaccctgttcccaactctcaatttctgtccagtttgcttgtgcattgttgagactgattacatgtcctttcttgttctctaaacatatttgttttccctgttttatctgtaactggattctaaaagctgaaaaagccaattaacagcatttacaatgttgtgattatggaaacagcgttcactgtaatgggccacaatttctttccttagggatcccgtatcctgactcctgtgtcatttaaggataatgctgcaaatgaagtatcctttgttttctttttctgagatagtctcactctgaagctgaagataggctggagtgtggtggtgcaacctcagctcactgcaacctacgcctcccgggttcaagcgattccagtgcctcagactctcaagtagctgggaccacaggcgtgtgacaccacattcagctaatttttgttatttttagtagagatgggatttcaccatgtgggccaggctggtcttaaactcctggcctcaagtgatttccccacctcggcctcccaaagtgctgggattacaggtgtgagtcaccgtgccaggctccaaaaatcatatcccttaaaggacattaaaaaaatcatatgagaaaaatagctgtgtttttaacaaataagtactccccagtccacttactttgcaacactttatttttaccagccaattttttatttttagcagagccatagggtgaaatccataccacttccttgctctggcctgagaactttctacacaaagcacatccactgggctggccagtggggcaatggggctggactggatttgaccctctctaggcctcaggccatctatctgtaagatgaaggacttccttcctatagattgtaaatctcatcctaaaacgaaatgcaacctccactggcgacctctttcactggacccattagtaagatgtggagtctgacaccaggttgcagacctttccacagaagcaactctgggtaagagcaagatggggaactggaaatcagtaacatgcaggaacctatgagtctataacaaatccgtttccttttacatctacttgttgaagctctactcatttttcaaatcccagccctaacccccttcttcaagaaaccttctttgacctcctagtgagaattaatatctcactctcctaaatctcccatgtggctaagtttgtttctgtaaccagcagctatctgctcgctatggacccccagctcccattggatcacacatcattgggatctggaatactgtcatctctaccttagaatccccaagaaacatgacatttgtgttccgtgtttgctaaccttgaattaagttcatacaacaaattacttataaagaaggatgccctgaagaggcttttagactgccctatctcttactgtattaatgtcctaaatgtaaagatagtataatacatatcaagtgtaacgaatattcatgccttcaaatgctgatcaggtgtcacctcctccaggaagcaagattttactattctcctgctgggaggtcagtgccctcctacacagaaacttgctcacttgtctcttcccaaaactgccagttctctgagggccaattctttctcttttatctctgtattgcaaatggctaacacatagaacatgctaataagcgtttcctaaaagagtaagaaataaaagggataatagaaaacaagacagttaaaaataataataacaataataataatctggttagaagatgggcaaaagaaatgaatagacatctcaccggaaagtacataaagatggcaaataagcacatggaaagatgttcaacctcattagccaccaaggaaacacaccttcaagccacagtgaggtatgactgtataaactatcagaatggctaaaataaggttgggtgtggtggttcacgcctgtaatcccagcactttgggaggcctgggcgggcgaatcacgaggtcaggagtttgagaccagcctggccaacatggtgaaaccccacctctactaataatacaaaacaattagccgggtgtggtggtgtgtgcctggagtcccggctacttaggaggctgaggcaggagaatcgcttgaaccgggaggcagagattgcagtgagccgtgattgtgccactgcactccaaccttggcgacagagtgaaactgtgtctcaaaaagaaagaaaaggaaaggaaaggaaaagaaaggctaaaataaaaaatagtggcaacataaaaaaatactggcaacatcgaatactggtgaggatgtggaaaaactgaaacaaacacagatttctgaagggatagaagcgatacagccactaaaaaaaaccagagtttggcagtttcttctaaaactaaatatgcaatgaccatacgacccagcaattccacagttgggtatttctcccagaaaaataaaaacttatcatctttatacaaaaacaactacacgaatgttcatagcagctttatttgtggtaactaaaaactgatgtccttcaaaaagccaatcccaaaagcttacataatggttacatttatttttatttctgtatttattttttgagacacagtttcactctgttgcccaggcaggagtgcagtggctcgatcttggctcactgcaacctccacctcccatgttaagggattctcttgccttagcctcccaagtagctgggattacaggaatgcaccaccacgcccacctaatttttgtatttttagtagagatggggtttcaccatgttggccaggctggtctcgaactcctgacctcaagcgatccactcgcctcagcctccccaagtgctgggattacaggcttgagccaccatggccaaccctgtggttacatttatataacatttttctgaaatgatagattttagaaatggaggacattgttagtggttgccaggggttaagggatggaggtgtggggtggggggatgtgtagttataaaaggaaaacactagggatccttgttagtgctggaactattcaatacctgggctgttgtggttgatatatgaatctacccagttgatacaattatatggaacttaatacacacacacacacacacacacacacacaccacacaaagaaactgacagtctgaaaaagatcagtggactgtatcaatgtccatatgatggttatattatactatagttttacaaaatttttggtaccaaaattatcaaaatagaaaataactttttctttttttagacagagtcttgctccccaggcaggagtgcagtggtgcgaccttggctcattcaacctccgcctcctgggttcaagcaattctcctgcctcagcctcccaagtagctggggttacaggtgcccgccaccatgcctggctaattttttgtatttttagtagagatggggtttcgccatgttggccaggctggtcttgaactcctgacctcaggtgatccacctgccttggcctcccaaagtgctgggattacaagtgtgagccactgcacctggctgaaaataattttttaaaaacccaccaaaatgttagcatcgtggaaacctgggaaaagtaaacaagggacctctgtattatttcttacaactgtatgtgaatctacaattacctcaaaataaaaagttaattaaagaaacagagaaagacatgggagaaagagtaccatgactaaatgaatgggctttttttttttttggcaactgtcaggacttaaaaaaaaaaatttagaataggccaggctctggcctcagagagcttattgtctagttggataacaatgacttccaattcaataaaggatggaggaagatgagggagctgtagctgaggcagtgaggaaaaatttcagagggaggcaggctgagaggtaggaggacagggatggagcccagaggatggtgtgaggcccgtgggtccagcttttgccctgctcagccctgtggcacaaacagtagtgctcaggggtactgtgtacattaacaatgtgtgcaaccatcgccaccatccatttccagaactcttcatcttctaaaactaaaacaatgtgcccactaaacactgattctccatttcttccctctctcagcccaacacccagcactctattttgtgcatctatgaatgtattttaggtacctcgtgtaagtgaaatgagaccagtcatgctaagcctcacaacggtgatacgctctgagaaatgcatcattagacagttttgtcattgtgtggacatcatagagtgtattcacacaaacctaggttgtgtaacacttacctcacacgtaggctatatggatagccttttgctcctgcgttacaaacctgtacggcattactgtactgaatactgtaggaaattataacacaatggtatttgtgcacctaaacacagaaaaggtaatgcactgcactacaacattatgacagctatgatgtctctagacaataggaatttttcagctccatcataatcttatgggacaaccatggtatattcagtcccttattgactgaaatgtccttatgcagtgatgactgtatttgtcctttcatgtctgggttatttcacttagcatagtgtcttctaggttcatccatgttgtagcatgtgtcagaatttcgtttctttttaaggctgaataatattccactgtatgcaggcactgcattttgtttattcatttgctggtggacatttatgttgtttccattttggggttattgtggctcataagtctgctgctatgaacactggtttgcaaggatctgttggagtgcctggtttcaattcctttgggtgtatatgtagaagtggaattgctggatcttaagataaatgttcagctttctgaggagttcccacactgctttctgcagcgctggcaccattttgcattcccaccaacagtgcaccacagttcaaacttctccacattcttggccaacacttgttattttcctttgttgttattgtttttttttttttaatagtactcatcctaacgggtgtgaaggagtatctcactgtggttttgatttgcatttcccctaatgactgactagtgatgctgaacatattttcatgtacatattgagctctttggaggaatttctattcaaatcctttgcctacctttgaggttttttttaattgttaagaatgtaagttttaaaatggagatatcatcacttggaatttgaaaccactgggctagactgccccatgggcaagatgaaccaataattctcaaagcatttggtaaagcagagcaggggccattttcataagaatctgagaacaagatctgcccactcatcatgagggcaaggggtctgcagtgaatcttgagcccccctcccctgctgcctggtaacctcctcttcggtctttaaaaccctagtgaggccgggtgcagtggctcacgcctgtaatcccagcactttgggaggctgaggcggacggaccacaaggtcaggagatcgagaccatcctggttaacacggcgaaaccccgtctctactaaaaatacaaaaaaattagccgggcgtggtggcgggcacctgtagtcccagctgctggggaggctgaggcaggagaatggtgtgaacccgggaggcggagcttccagtgagcccagatcataccactgcactccagcctgggcgacagagcaagactatgtctcaaaaaaaataaaataaataaataaataaataaataaataagaaagaaaccccggtgaatccttccttcctcggtgccacctctaggcctggacagtcttatcactcaccagactgcatgacaatgatttgtttccctctctgctttccctactattaaagctccttaagggcggggcaaggttgattacatgcaataaacaccaaatacacatacagtgagattttatagataatcccaggctgattctccagactttccacagctatccctgaatcatgtggtattagccgggccacctaattccttagtccttcctaatttttttttagtgatagcagagatgacatgggtccagaggtgtgacttgcaaaagtcctttgttgaaacattcagtatattaaaaaaatgctctcgtttgatttaaaaaataggaccattgcagacatgggcaggtctggtgggtcagtgtgcactggcactgtctaaatagcaggtcatccttttccgggaaggggcagtggttctacatgaggacactgcccttgtgttttatgtaaaaaggaagccaaatagaccaacaaacacttgtcttttcttcatgaagtaggtaatacaccagtagcaactccctgattcttccctgaaacaatgctaagagctggtatcccttccctgtatcatcacacttgtccactcccactgcagcccacgtcaatcctgctgcatcccaccccaggaaggtcattcagatcaaagtcagaaaaagcacatggtgaaaaggaggtgagcctgccaatatcagagttccaagtgacatctctgaacattctgtgattctgagactggctggctcttaccctaacagaactcacaaatataaatcagcaaacacaggcccaccactttaggctgcaccatccacagctgattctcatcaataaagacgccatgcaaaaacaaacaaactaggtgtgggaggcagaggccccagcttcagaatgagacctgctattatggttttaaagattgtaagggctggacgtgatggctcacgcctgtaatcccagcactttgggaggctggggcaagcagatcacctgaggtcaggagttcaagatcagcctggccaacagtgaaactccttctctactaaaaacacaaaatacaaatattgtgtctggaattggtgggttcttggtctcaatgacttcaagaatgaagccgtggaccctcgcggtgagtgttagttcttaaagatggtgtgtcagaagtttgctccttctggtgggttcgtggtctcactggcctcaggagtgaagctgcagaccttcgcagtgttacagctcacaaaggcaatgcggacccaaagactgagcagcagcaaaatttattgcaaagagctaaagaacaaagactccacagcgtggaaggggacccaagccggttgccggggctggcttgggcagcctgcttttattcccttatctgaccccacccacatcctgctgattggtccattttacagagagctgattggtccgttttgacagggtgctgtttggtgcgtttacgaaccttgagctagacacagaatgctgattagtacatttacaatcctttagctagacacaacagttctccaagtccccactggactcagaagcccagctggcttcccctagtggatcccgcaccagggccgtgggcagagctacccgccagtcctgcgccgcgcgccggcactcctcagcccttgggcggtcaatcggacaggtcgctgcggagcagggggcagtgcccttcaggagcgggggtggtgccggctcgggcatggcgggctgcaagttccgagccctgccccgtggggaagcggctcaggcccggcgagaattcgagcgcagcgcggacgggccagcagtgatggggaacccagctcaccctccacagctgctggcccgggtgctaagcccctccttaactggggccggcagcacccaccaagccagcgcccacccagaactctgcccgggagcgccgtgcgcagcccgggttctcgccggcgcctctccctccacacctctccacaagcaaagggagccgctctggccgcggccagcccagagaggggctcccacagtgcagccgcgggctgaagggctcctcaagcatggccagagtggatgccgaggctgaggaggcaccgagagcgagtgaggcctgttagcacgttgtcacctctcaatattaaaaaatacaaaaaaataaaaattagtcaggcatgggtggcacgcgcctgtattcccagctactcaggaggctgaggcacaagaatcgcctgaacctggcaggcggaggttgcagtgagtcaagatcgtgtgtgtctgtgcctgggtgacagagtgagactccgtctaaaaaaaaaaaaagactattcaggggcttttgaataaaatctgctctaaccacacaaagaccgaagatcaaagccactgaaaacactacttactatttgccaggcaccaaaattatctgtggaattgtagagaatggagacagttatagttcctcctgtgaattcatgctttatattaaatgaactgtacagtactttctttcttctcccttaaaattgtttttagactctggggcatgaagtttatgttaaataaccaaataaacatggaaggttatcagctccaaagtctttaaccacaacgtatgatagagatccagccatctggaactaagattcatgtttgagctcaacaagcactgaggatctaaggatcagatgaaaggtgcctggtcaacagcaaagggccacatgcaggatgttgctgtaattgggaaggcagggctccactaggtgtcaggcgtgatatggttaagcttgagcaaaagcaagtacaacagattgtatttctttctttttttcttgttctgtcacccaggctggaatccagtggtgttatcacggctcactgcagcctctcagactcctgggttcaagcaatcctcctgtctcagcctccaaagtagctgggaccataggtgtgcaccatcatgccaggctgatttttctttttttaattgtagagacggggtctcgttatgtggttgaggttggtctagaactccttggctcaagcgcctcctccctcagcttcccaaagtgccaggattacaggtgtgagccaccatgcctggccgagattgtatttctgacattcatggctactttcacctctccgggcttaaatttcctaaccaagaaaaaaatagagtcaagctatatatatatattagtcaatatatgtctagtgaatgaataagtaataaggagaggcaggctggatctgcatctccaccttttgacagagtcgctcaccaatttccagccttgagcacagcacttggaagatgcatgttgcttactgagaggatggtgaggaccctaagcggaggcccaggtagtgtctgtcagcagagggccaggttggtgggaggggcctgcttcagcaccagcacttccagtgggcatgagccatgagttctacacctgccaagacccacgagccacagggaagtcaagctcacagcgaccaccagggtagatccctgactggacatgatgaggtcttcgaggactcctgtactgtcatttctatgataacatgaaaggcaggcacctgtccctgaagaagacctgactttttagagacagacttactcagtacataaacgtaaagtgacatgaggtccagatcactttccagtacttcagcagtaacaatgaaaaagggagggagagaaggacaaaaacagaagaaaaagtgacagatgggcaagtgcagcaaaacttgaaaatgctgaatctgctcactgatactgtactagtctctctacatttgtgaatgtttgaaattgttcactgtaaaacttaattttaaaaagatacataggcttatgcctgtaatcccagcactttgggaggccgaggtggacagatcacaatgtcaggagatcgagaccatcctggccatcatggtgaaacccccactctactaaaaatacaaaaattagctgcgcgtggtggcacgcgactgtagtcccagctactcaggaggctgaggcaggagaattgcttgaaccagggaggcggaggttgcagtgtgccaagattgtgccattgcactccagcctggtgacagagcgagattccgtctcaaaaaacaaaacaaaatacaaaacaaacaaaaaaaatatatgtgatacatgttaaagttaaaaaaaaattataaaaaggtacaaagcaaaggataaaagcctctctccctcctgactcccaatcacgtttcccagagatgaccactgttaagttccatggtagccttcaagaatttttcaggtttatattaataagcagttataaatatttaaaatattttctccctgctatgaatttttctattattaacccagagggtgatgaggaaaatttcataatacttatttaagttctgtatatcaaaaaatttggtttaaaaaatacagtaaagttcctactggacatatgttataaaatataactgaactatatttaattgagctgctaacaaaatcagcttaaaaattaaaatgtattatagcaaataaagaaaggccagtctcatttttctcttaagatgtcccaggcatgaaatttttttctttttttaagatggtctcgctctgtcgctcaggctggaatgcagtggtgcgatctcggctcactacaacctctgcctcccaggttcaagcaattcttctgcctcagcctcctgagtagctgagattacaggcacacgccaccacgcctggctaattttggtatttttagtagagacaggttttcaccatgttggccaggctggtcttgaactcctgacctcaggtgatctgctcacctcagcctcccaaaatgcagggattacaggcgtgagccaccacacccagcccaggcatataagggttttaacaacgtattttatagacttaaagacagctataagtcaaagctcagatcaaacaaatgattaagttatgccagctatttccattgataatatccaatttaaagagcatgctcaatttactcattttaatccttaaagaaaaatttagcagaaaaagtccttaaagaaataaaaagaacacatactgaggctgagtttatatttgaatgtatctgtttttttgttgtatgtttgaatgaagacctagagaaaacatggcaacattcactttcaagagtgagagaatgaagtggagcaggaatagaatcagtacataaatcctgtcaacatttattagcatttgcaaatctgactcacaaaacctcagcctaatcagactggatttttgcatgtcatgacaacagcatacaacattgtttctggagggatcagctgcggcagcctcctactgtcctttggtgacaaggctttaatgactccataaatgtatgctgcccagctgctgcccgcttaattagacgatgatttccacttgattgaacctgcccagcagccagttgtcacctaacattcacaggagaccacactggtctctttcagaactaccaggatcaaacagtcacacgagttctatggttcctacaacatggcagtatactgtttgatttaggacttgaatcatatttctccctttttaagaatatacccttctctgccagaaggttgttacttctcagattaaagatgtgaaaggaaaccttccaaggctcatcttaattggacatatacatcatcactttagtatacagggatgggatgacaaatgctaatccgggtatggaatatggcaaggaggattcacactaagaggacagagaagagaattacatttactgaactctggcaagtgccaggtgccttacatctttgccattcaaacacggttcatgaaccacagcctggcactcacttgggagctggttaccaatacagaatcttggatgatccctggatgatttgtgtgcatggccaagcttgagaagcactacgctaagttataaggctttatttaattctcacagccgtttgaagaaaacattatttccatacttcacaggtaagaaaactaagaaaatttccttccttcttttcctcctcattacagaaaggatttgcaggggaaaggggcatgcccaagtttctgagctggtcatcgggaaagctggcattcaagggtgcatctgctgcatcccaaaggcccttgttctttccaccttcccccaccgccccaggctccttggatgatggtcagactccacctagaaccgtgtttaggaactgatactgcattcattctttcattcattcatccatgaatttattgagctagagtctccctctgtcacccaggctggagtgcaatggcacaatctctgctcactgcaacctccgcctcctggttcaagcaattctcatgcctcagcctcccgagtagctgggattacaggcacctgccaccacgcccagctaatttttgtatttttattaggacggggtttcaccatattggccaggctggtctcgaaatcctgaccttgtgatccgcccacctcggcctcccaaagtgctgggattacaagcctgagctcacgcctgtaatcccagcaccttgggaggccgaggcgggcagatcatgaggtcaggagatggagaccatccctggctaacacggtgaaacctcgtctctactaaaaatacaaaaaaaattagctgggcatgggggcaggcacctgtatagtcccagctacttgggaggctgaggcaggagaatggtgtgaacccgggaggcggagcttgcagtgagccgatcgcaccactgcactccagcctggaccagagagcgagactctgtctcaaaaacaaacaaacaaacaaaaaaaacaaaaacaaaaacaaaaaacaagcctgagccactgcacccgatctggtactgcatttgaaaatgcaacctgtggcatgtatgagggtgacaagttttagtcatatacatctatcagaatgactaaaaacaaaagtaaaaaacacaaaaatgctaagttttggtgaggctgtggggcaacaggaactcgcacacaatgctagtgggaatgcacaacagtacagccgccgtggaaagcaggatggcagtttctactaaactgaaagaatcccattccaaggcctcggcctaggagaaagaaaaatatgcccacacagacttggatgcagatatctattagcagcattatttgtaatagtaaaaaactaggaataacccatttgttcattaactgataaatggataaatgaattgaaatacatccatgactggaatactactcagcaacttacgttaaatgaagactatgtatgtatgatttcatttttatgaaattataggacagcaaaactttaaagacagaaggcagacgggtgtttgttggggctggtgatgggcactgggatcatcttcaaagggacatgagaaaacttttactagaagcgtgatggaaacgttctatactacgattgcaagggtggttacacaactctacacaatcacccaaattcaccaaactgtacacagaatgggttttattatacataaattataacaataaagctggagggaggaaaaggggaatttagaaaagtggctgataaccatacaaatataggtatatctcaacagctttcactataataacaataatcagtccaaatacaaaggagagaggccaggcgtagtggctcatgcctgtaatcccagcactccgggaggccgaggcagctggatcacttgaggccaggagtttgagaccagcctgggcaacatggtgaaaccccatctctactagaaacacacactaaaaatagctgagcacggtggcacgtgcctgtcatcccagctatttgggaggctgaggcaggagaactgcttgaacccaggaggcagaggctgtggcgagctgagatcgcgccactgcactccagcctgggcgaacagagtgagactgtctcaaaaaataaaattaaattaaacaaaatacaaaggagaaatacagtagcaatgaaaatataaaatgttttgaaataaactttaagagactgtaacagaagatttaaacaaattgagacctacccagttcttagaaggcagactgtattataaagatatcatttaatctcaaactaatctataaagttaagaaaaccacaatcaaaataccgagtattagaacttggcaaagtgaaattattttttatttttgagacaggatcttgctctgtcgcccaggctggagtgcagtggtgtgatctcagctcactgcaaactctgcctccggggctcaaacgattctcctgcctcagcctcctgaatagctgggactgcaggtgcatgctaccacgcctggctaatttttgtacgcacctggtcagcaaagtgaatttaaaagtacatctggaaggatagatcataattttaaagtgtttgaaaaagaatagtggggagaagtttgctttatcagatattgaactacattatagtgctgaaattattaaaacagtggctagaactggaaccaaaagattcctgaaacagaactaaattcaaaaatccccaaacatatccatacatataaaatactttagtatatgataaagctggcatctcaaataagtggggaaagaatggattagtcaataaatggggctgacaacactttcttgccctttctccccaaaagcgtaataaagtgtgggtgaaattgtttgtactaatatatgaacaccttttatagatcattaaggaaaagacaaacatccccattgaaaaacaggctatagaaggaggatcccaagatctacgccccagaatctcgtcccaaagcctagcaccaaaacagcaaagcagtcctccttcaagaaaactgaaggcagctggtcatggtggctcacgcctgtaatctcagcactttgggaggctgagacaggcggatcacgaggtcaggagttcgaaaccagcctgaccaacatggtgaaaccgtgtctctactaaaaatacaaaaattagctgggcatggtggcacgtgcctgtagtaccagctactcgggaggctgaagcagaagaattgcttgaatctgggaggcagaggttgcagtgagccaagatcacgctactgcactccagcctgggcgagagagagagagaaaaaaaaaaaaagggacaagaattagagactggaattgtggcagtgggcagtgaggaacagacggtgatgtgaactggagaagggtaatgcccagcttcagagagggcgtggcacagccactgggcctcaagatttctcaacgaaaaaccattcacaggtgttaggtgggatgcatggagagccagccaaggcccaggttttctgtgacagctgtgcttcaccctgcaggacaaggctaatcagactacaccatgacaaaagtgtggaagcaacaaccaggcagaggtttattaggaaacaggtcaacctccatggccaagcacacatcagacagcgagagctgcctgccgcgtctgcacttttacccttcttcggccatcctctcgcccagaccttcatcttcaaaagaaccaagagcccccagcctgccctgaggtgcctctggagctaccctcctgctcttcctccgcccaccaccaaacctcctgcagggctttcatctactgcccagcttctcctctacctggcctataagcctttggcttctggagcctccctcccatcaatcccactctcaccattgacttcctggttgccaggtgcctcaccttttattttctttctttttttttaatggtgctacagcaatttatcagtgttcttgaaattccattctgtggatcccaggaccccagcactctcctggttcgtggtctttcccactctctcctaggatagatattttaaaagattctgctcttattcctcagctctttcacccttctgttctctctagctcagcaaaagcagtcatacctggggcttcgtgctatctcccccaactcagaaaagaattcccagcactctctcttctgccctgactctgtctctccaactcaatttacatttttcaattgccttctggccattctctctctcttctttttgagatggggtctcactctgtcacctaggctggagtgcagtggcgtaatcatatctcactgcagcctcaatctcctgggttcaagtgatcctcctacttcagccttctgagtagctgggatcacaggcatgcagcaccacacccagctaatttttcgtagagatgaggcttcactatgttagcaaggcctcactatgttagcaaggctggtctcgcaactcctagcctcaagcaatcctgcctcggcctcccaaagtgcttattacaggtgtgagccactgcccagcactattctctcttaactgcacacgaggacccccgactcatagttctaaagccagattttgctgtcttagttaacatgatcaccattacccatgttgctcagggcctaagccccaagatcatgtccacccccaatctacaagtggccactttgacttaccacattctcccctggaaagtctctcacagttagctttcctccccattttaagttccaacaccacctcagcttgcctctctcttttttttaaatgactccccacactacagcagttgctttttgttgctcttcttgcccctcaactccatcctttccaatccaacctgcaccatgttgagagacaattctccatgaatatctcacatcctgcactgtctgggtctctgagcaaagacatttatatcaattttaagaatgtttctataatgagcctttccagagtagtaaacctgggagacagctccctccagagaggttctagggtggtaaagatcaagacctcaccttctcctcctcagaggtttacattcctaagataaggtctctccagagagaagtatggacaggccaccaccagctcacaataagatggacgcgtagttctggagttcctttcttgtaacgcatcccactgcatgtacaggcagtaacatctggccttcattatgttgtcctgtggggtttgggccttggggaatcaaactggactaccttgttaacttctaagttgggtaaaatctcggacgctagagtttctgacttaacacatcaccactaaattatctttatgaagatctgctttggccacgtgacttccctgcttgaaatccttcagtggcttctcactacagaatacaattcttacctgtcacctttccagctggtcctcccacttcttatgtaaaccctgtgctcctgtcaatctggactacaggatgtgttccatacacaggcattcatatcttgcctcatgtttctggccatgcctgaatgctatacatagattgcagaagagataaaattttatccatgaagcaccagtgcctaggctgcccacagcgacctcagaatggtgaccccaccatttccttcttctagtatgttgccatggctccttccaggtaggctgatgggaagtcagcctgccctctgctgtagtcataacgagctgaactgatgaccagtgctggggcccaaggtgactgcactctggttggacatctgggaaatgaactgcccctgggaatgcttggcttgaaactgtccaacaggatagctttcaatttgatggcagccaaaaaacctacagagctcctctctttaagaagtgtcagggggtggccaggcgcagtggctcacgcctgtaatcccagcactttggaaggccgaggcaggtagatcacgaggtcaggagatcgagaccatcctggctaatatggtgaaaccccgtctctacaaaaaatacaaaaaattagccgggcgtggtggcgggtgcctgtagtcccagctactcaggaggctgaggcaggagaatggcgtgaacccgagaggcggagcttgcagcgagccgagattgcgccactgcactccagtctgggtaatagagcgagactccgtctcaaaaaaaaaaaaaaaaaaaaagaagtgtcgggttaaggagaggcaactcatcttctagtgaacaagtgagttttaattttggttctcccctaagctctacatcttagtcttagcttgtcccacacttctgggtattcttgcaataaactcccaagcaaagacaacatgggcatgtattttcttgcagcctcaactgcttaattcaagtgctctccccactgatctctgagacacatgtacaaagacgttggtagatgcattgtttgtaatgacagaaaaatgtgtccactaatatgggctggttaagtgatcgtattcatcaaatataagatacatcccaatttagagacattaaaatatcaatcaaatggcctacagtagttacatgatgtagttgattcttctaatatgtgaaaaaatgtgggtcttagacttggagaactaaggtatggtgtattcacacagtggactactttgcagctggggtaggtaatggcacaaaaggaggtgtgtgtcgtgttacctgtaacaacctgagcttgaaaagtaaacagtcttaaaccaagtggtgaacacacgcatatagtttaagtatttttacagctttttgtttgtctaaggtatgttaaacatttttcttttttttcccaagatagagtcttgctctgttgcccaggctggagtgcagtggcttgatcatggctcactacaacctccaccttccaggttcaagcaattctcctgcctcagccacccgggtagctgagattatgggcaccgtcaccacacctggctaatttttgtatatttagtacagacggggtttcaccatgttggccaggctggtcttgaactcctgacctcgtgatccacccgcctcagcctcccaaaatgctgggattacaggcatgagccactgtgtccgatatgttatacatttttatatatatacattctgatatgctatatacagttatacccagccaatatgttacacagttttctctcactgggcctagcaacatttttgttatgttatacattttgttatacattttttctaaccgggcctagcaatctgctttatctcccttgttctgtgggaaaccttgtgttcaagtgatagcttaaaaatcaattctcggctggtggcggtggcggtggctcacgcctgtcatcccagcactttgggaggccaaggtgggcagatcatctgatgttaggggtttgagaccagtctggccaacatagtgaaacctcatctctactaaaaacacaaaaattagctgggcgtggtgacgggcgcccgtaatcccagctactcgggaggctgaggcaggagaatagctttaacccaaggggcggaggttgcagtgagccgagatagtgccactacactccagcctgggcaacagtgttagactctgtctcaagaacaacaacaaaaaaaaagacaaaaaaaaaaaaaaagaattctataaataaaggagttgagagaaacattcactgtcccttatctctacatgttgattatcagaataaaaagaattccagcaacatcagtcatgggcacaaagccaacccgtaaacatttacagaactcgatgattacccaaaactcggcttgctttctcaatactactgactttggcttcacattagccacaggtgtgtctagagttaaacaaggtcaactttacaaaaaaaaaaaaaaacaaactgatacttgggcatagtttaaaaaaaacttaaaagtgtgtgtgtgtgtgtgcgtgcgcgtgtgtggtggggggcggggcatttcaatataaatgccttaaacacaaccttcctggctattttataaaatgggttgaatctctaaggacacatatttcctaagacctcgactgatacacagagtgcaaacttgggagccagactagactgcctcagaatcatgccagctgtgtggcactggaaagtcacctaattttgcagcgcctaccttcacctctgtaaaatggggaacaataataactaatttatggatgctgtaaagatctgaaattttaaactcagtaatgcgcctggcacacattagacacgggtgtttcgtttgtcttggcaaaggcttcgggttttgcgacaatagccttgctgcctccggagcaagcatctctccttgccccctctggggcatttaaaaatgacctcaattctactctcaattatgtccagttcaacagttacgtgcaggttacaaagccgaggaagctgaggtatcttctaaactaacatagcacgtacagaatttttttaaagtttggtggaggaatcggcagcacaaggtaagctgcgctctgttcacagacctgggaatcagaactccggccgccgcggcctccaggcgcctctcagctaacagacttcctgcagcagggggaggggcggccagctcgctgcaaaaagccgcaggaccccctcaccccgccttgccgcccccgctcccactctctgggatggggagtgcagggtctaggcgatggcacttaccagcgcgaagtgcaccagcgcgtcgtagcagagccagatgagcgccccgcggtccgccgccccctgcccgcggcccaggcgcaggcccagggcgcagcccgccgccagcagcgcggcgcacagcagcagcgaaccgccagcctcggcccccagctcccactcagcgcccatgcttcaggcttccgacgccaacggcccaggaccatgcggcagaggaaagcagggagagaaacgacggggcggggctggccgggaaggggcggagccggatggccaaggaggagcggagctgattggccaaggcggtccggggagggacggggctccccggccgggtcggggccagagcgaggattccgtgcccgcctcgcaccctggccagcctgctgagtccggtggttttgccaggtgccgcccatggaggttccgtagaaggaacgtgctcaccaacttgcgcaaccgcctcgaccaaacctgttcccaaaccgagcccaaaggattggtaatagggccacaccttttgatgttgtttcgcttttaacaaggctcaaactttaagccacaaagtgaagcctaggtagtggaaattttgccagtagaccggggcagaattttaggggcaaaaggttttaattaggctgcagcaagccttaccagggaggctgggggccaagggagttttcagccaccagccggcttaaagcctttatggcctactctgacaatctttccatttcttaaaaatccagaaaagtagaagggtgggtgagaggagcggtaagtcctattggcttggcgatagatgcgtttaacctgtggcaggccaggtttcactatcgcaggcctccatcacaactgcttcagcactgagtggttaaattaaatattaaaagctgaggccgggcgcggtggctcacgcctgtaatcccagcactttttgccaaggcgggcggatcacgaggtcaggaaatcgagaccatcctggctaacacggcgaaaccacgtctctactaaaaatacaaaaaattagccgggcgtggtgacgggcgcctgtagtcccagctactccggaggctgaggcaggagaatggcgtgaacccgggaggcggagcttgcagtgagccgagatcgcgccactgcactccagcctgggcaacagagcgagactccgtctcaaaaaacaaaaaaaaaattaaaagctgaaagagtcagtgcccatataccaaagtctggaatgtaacaaaagcccaccaagagttttgcctaggcctttcttgggccttgaagcatgacaagataactaaggaatttttaacaggacccgtttaggattaaacaagttttattgggggtctgaagaaactccccaggcctccaaaaacaagtttattgggagtctggaggaattccacaagcctccatgatttagcaagagacaaaataagggtaatcatcccagcacccagacctatttagattaagtaaatttactgaggctccagaggaaggtcttcaggattagaagttgttaatcacttacgtctttagatgaatgcactcttacacgtagacatatagcttagaaggtatatacgctctggaaaaactttgtaattatgagttggtctggcaataatttccagaccttctccctgtaaccggttgcagaaataaaaactcttcttccccagttcatctgcacctcattattgggctgcccaacccccagtttggtccgggaacaaacctacattatttaacatcacaacaaccctatgaggtcggtgaaataagccagtcacaaaaacatacttatgattccacttacaggaaatatctaaaataatcaatttgcagaaacaaaatagaatgatggttaccaggggtggggcggggcgggagtggggggggggcgcggggaaaagtggagtgttatttattcggatagtttgatttgcaagatgatgttctggagattggttgcacaacaacgtgaacatactttactgagctgcacacttaaaaatggttaagatggcaaattttatgtgtattttacagttattaaaaaaaatgctggcactgaacacaagaaatttttcccttagtcacttcctataccattttttatagcagttaacaccagatagaatgatccttgtttacacacttattgctaatctcctgccactataatgtaagtcttcaaggccaggggttgtggctagcttttttattgctgtatccctggcacctattacagagtttggcatatattagctgctcagttaaataactggcgactgagtatggtcaatctagccacctatgctctggatcctgtcctgtaactaacttatcatcctttagggaccactcggcccacctccccttcagagcaaaatagaaacttaatgaaaaaactgatcagatcccctgtcttcatgtcttgaccctgctcctcagtcctttctactctggtttctgccttatcacactgatatagctctcactaaggtgactactggcctccacatcactgaaccccaagaacagttcattttcttagtgtagtttacttctcagcagcatcccagcactgaaatatttttcctttggttttctgagaatacagcctccttagccattctgtttcctttgcaagtgcatcttccactacaaatgcctagtgaatgctgcagctccacaacccagtcctcggccctgttctcactccagaccccaaatccaggcagtctcatccttaccctctgctttaatgaccagcaaaacctgcagagaactcaaatctctagcctggtcctattctctggactccagaccagtatttccaactgccctacttgacagtcacttggatgtctcaatataacccaaactgagctcatcactttccaccccaatgtctgattctccttcctatctcatgttacttccactcatcagttactacaacccggaaacctagaaatcatccccgatacttctctctccccaaacttggcatctaaggcatcaccaactcctcctcagcagccaagtatttcttgattccatgcatttcatggacctgttcaccatctcgtctgtgcttcactcactaatgtgaccagcgacctctacatcactaaatccaaaggacgttttctgtccttagccttaccaactagtgatctttattaatctattatccctcttgcttaatgatgatcttcatatagaataccaaaatcctttttatgacttactagactgtggggtctggcccctccctatctctttagccctttcccattcccctattaatcctcctctccattataatctttcatctagctatacttgctttctttcacttcctcaaataccccatggtgcttcccacaaggctttgtacagactcttcccactgctggaaagcttttccagtcaatgtgcccaataaactcctgccttttcaccacgatcagtgaaattttggctggcactttttaagggctcaacattagcctggttatcacctttctcagtagccaatttcctctagtatgtgtatcattgtatacctctttttttctaacatttgtcaaaacttgtctttttttttattcctgttatttttacaagtatcctgtgccatagcacagtacctggcacgggacagagtattcagtattcgaatgtttctaaaggcttagtcagaattcttatttatataagactgaagacatcgaaaggatacatatgtagaatgtgatctcatgagaaaaactaggctgaagtaaatatgaaatttattcttatgtttagagttgaaaagggtagatgcccaacgatttgggttaaagagagctgatgataaagagggtgtgacttgatcacaaacctaattatgatgaagctggtaaaataactgaaagactccccccacattaatagaatcaaaagtccagataatggaatgttcccattcattccaaagtactcagaaaccagtcacaccacactccttattgttggaatccttggagtacatcacgctgacaggaaccaggtccagcaatgactttataatgagaatggatgaaatgcaaggggtgttcgagtaaaagaaagctgatttaaaaaatggatgagtctcctctgctatctggaaataacaaagtctactcccaatcaaaaacagttaatttacaatgatggaaatttaagtttctttctcttttgagacagggtctcaactctgtggcccaggctgaagtgcagtggcacgatctcgggtccagtgtatggcagcctcagcctccaaagtagctgggactacaggcatgtaccgccaggcccagctattttatttatttattttttttgtagagatgaggtctcactatattgcccaggctggtgtcaaactcctgggctcaagtgatccactgacctgggcctcccaaagtgctggcattacaggtgtgggccactgcacccaggttaagaaaggatcttgtagcaagcaaagctagccaataaatacaagctccctcaaaatgagtaccttgtttctcaagctcttctaacttactcctgcaggaatgtttccataaaataccctgcctcaaaaatcagattttatgtttaaaatatgtaaaatgtatactttataacactttggcttgtattaccaataaaacttttacttaccacctagtaaagttgctgtcccacgaaagtgttccttatcttatggtttctcacactatttggcacaaggccccatgcatctttgggtaccacagtttaagggaattcctcaagaaggtgtatggcaatttgctagggtagggaagggggatgctgtagaagaaattccctgcagagaatactttctttatggcatggctcggccatagtttctgtttttaataatttaatagatgattgtaagttttctgatgaggccaatctctcaacaatgcttcaagtgatcttcaaactatgctatgattttctagtacaactccagttttccctagataacttaaagattttcaactacaagtgtttgaaaaacactgccatagggtgttgagatttgggcaattaacacatttgattgttttacaaccctgttttttagccacaggataaatttaagaggtaactagttgctccatatttctatttctttatcccaagtcccttgaaatagatgttcagtactacctggagtttcctacagatgatttgggaaattaggttaggcctgccttcaatttttcctaaaactcagaatgaagaaaaggcacatttgtgtctcctttcttcatcttatgcatctgaggaaagcctgggactgttcatacaacaaaaaagtcatgatttaggctgtctcatttgagtggagttttctataggaattgatttaggacagtggtttacaatcagggatggttttgggcccccagatgtttggcaatgtctggagacatttttggttgtcttaacttggggagaggagagaggtgctactgctatctagtgagtagagcccagggatactactaaacatcctacattgcacagggcagatgacacacaacaaagaattatccagccaaaaatgtcaatagtgcagggtttaaaaaaccccaatttaggccaggcgctgtggctcccgcctgtaatcctagcattttgggaggccgaggcaggcggatcacttgaggtcaagagtttgagaccagcctggccaacatagtgaaacttgtctctactaaaaatacaaaaattaggtgtggtggcaggcgcctgtaatcctagctactcgggaggctgaggcaggaaaatcgcttgaaactggaaggcagaggttgcagtgggtcatgccactgcactccaacctgggctaaagagcgaaactccatctcaaaaaacaaaaaaacaatttaggcctaagttagttgagggattttatgggcaaacagtggcattaggttgcattcccacatcccttttcccacacattgtatatagcacttttggagaatcattctatcactgttttttagctatctaaacaacatttatactcacagcttcatatacagaaattatatttcctttcccccaaaaagagttaagtaaactttcccagtttaactagggtttaaaaaattaaccatcactgtaagacaacggacattcatgaatgtcaggtgctcttgtttacttgtttatccgcattaactaatcccctgaaaaggatgaatgacgcttcttaaaaaattttcttttcatataaaaatagaatttttttaaagatggggtcttgctatgttgcccaggctgctcccaaactcctgggctcaagtgatcctcctgactcagcctcccaagtagctggagctacaggtgtctgccaccaaccacgcccttcaggatgacccttctgaaagaaatgatggcaagattgtatgagtactatcacatttacttatacaccaacttcttttaaaagtaatttgcagtggcattatacaaaagtaaacatttctatactcaaaagtttggctgctcctttgttcttttagttaatgcaagatttcatttagtgccataaactttacctaacaggttaaaacttttaggtttgctctgattactattttccatagttacatgttttcaaggggtagccaggtcttaaagtttgagtttttgtttcatcagtcacaatcataccatcatctcaaataaatggactttttctaagttatagtatttaaacctgagacacatagggagaatgccatgtgatgacggaggcagagactggagtgatgcagctacaagccaaggaatgccaaggattgccaggaaccaccagaagctaggaagaggcaaggaaggatcatccccatcgaagtccccagacagagcatggctcagtcatcaccttgatttcagacttctggtctccagaagtggatgacaatacatttctattgtctgaaaccacctggtttgtggtactttgtaatggcagcttaggaaactaatatagattttggcaattcttatttgtcacagaatagtctcaaatctagcattattatcgatcatcctggtttgttagagttgagatggaagaggaacccctcttaagggcctgccaggtgccccaccaagcatggaaataaaggaaaattttgagttccttcaagggaaattccaggcacctagctagccctatgaataaataagaaacttgataagcaagagagtaatagtagcttaaaacaacagccaaggaagtcacaggatgtttggttccttatagaaactaaagataacatcttaacatatgtccctgagttgttcttcagacacctggacccccaccaaatggtccactggccagggaagggggaactgaggactgagctctgactgccattctttgttctaaatgtcttcctgaggggcctataggaagtcacgcccatggggcagacttagcattcttttctgctgaccccaagttttttgacaaagctttgattccttaatcaactgcaaataagaaaatctgtgaattcacctatgacctataagtcaccccctgccaccctcggcttcaagacagcccacctttctaggccaaaccattgtgtactgatgtacaattctgcctgtaatttatgctttcctgaaattcacccctgcctttaaaaacccttgcttgtaaagccatgagggaagttgggtcttaagtgtgagctgcctcatttttcttgtttggtgccctgcctgcagataaatgccctcctttttcctgctgcaaaaccttgctatgaatgtttggcctaactgtgccaggtgaacagactccagtttagttcagtaatatggtgtgaaggagatattaaaatacagtaaaagagtaattcatgatttacctccattgtgatttttaaaaaaataattccaaatttaaatttaaccatacagaaaacaaacaagttattttcagaaataagttttcaatgttttatcatatttgatagcagctttttttattggttacaaaacctaagcccatatacaaaattaggaacacatttagatgcctcttttgaaagaacgttttagtctttttaaactgagtttaaaaaaaaataacaatgcaatttttaaacactgttttgaaaacttaaaagtgcagcaatatacttagtttcctttatctacgaaatggtgcaattccaattcaaaactggtaaggtcacaaattgaatcaaggaaatgcatacaagtgtctgcactacttgatgctaatgttcacttaaatgttagtttgcactttaaaacatgagaggaaataggaatcatcacagtagaggcccaattttaatcataatgtgtgcaaattttaaaaggtaactgtcagttaagtaaggaaagtccagaagaaactaaactggaaggggtacggttcacaatatcaagaagatttggacttttaagggtttcaccgaagtttgtgaccttaattagcttttacgttgttattcctacttttagcgaacaccacacagtttcaaaaatttagactatagtgtccgaacaggatgcagttaccatatgaagctttaactcaaaatttggataaagaaaaaaaggcacaatgaacttcaactcaattttatgtgcacaagagttgaaaaatctgagccaccttaaagagaaattgattctaaaatttataaaacctataaataatcagaggccaaaccactatattaaaacagattctctagcaagtaaaaatcttgcagtttaaacatacgcttgtatccactttagatacaagacaaaactcactctttaaagtggctccaccttggcagatacatatatttgtaatgaatgcacacctgctatgtgttgtttatcagtgaaaacaccccagctgattcacaaagctctgatggcatctgtctcatcttcatcacagtaaatacaccccccaatggataactaaattagtttagattttctatcccttcacatcaatgcattgggaaattatacccagtaaacaagagcaacaataccatttctgtgacagcacaaattatttagtttaaaaatttttaaatccatattctttcattaataactgggtcagacaatttaccaaaagcaataacttgacatagtaataccggattttgcagaattacttagagatcactgcaaatcaggtttatgttaaataactgcaaattactcctctacacagatccctgtctgaatcttttaatatgtgaagatgctttttgagtaggatctgaattaactttcccaatactcaaagaatgaactcttatgacacttctaaatagttgctggtttgttgccaaccacattatcaaaagcactggttactaagtaaaaaatattttaagactaaattacagtaaacatgaaagctccacagtttaaacccaatataaatcaaccatatccaattatcaaattaaaacaaagaatattaactcctgaaagctgaaagcaagatttttttaaaaaacatcaccaatgggtattttagacttttgcagtttttttttgtttgctttttgttttgctgtttttcctttatactcagggactcttgctttcaacttaaacagaagttcaagtccataacaggttgcagctcaggtaaaataccatgcacagcatttgattacttcaaaacagcaggaacacacaggctgaagagagtggtcaaatagggcttgctgttctcaaaaattaggtataatggcaaaagcattaatatccatatctaaagttcttcctccaaccctggcttctgaggcagataataaacacatcaattactggtagatgaagtagtttttttttttttttaaacttatctgtttattcaataaccaagtttcttgtttttaagttactttttttgtgtcagttccaccaatgaaaatcatttggcttgtactttaaaatctattcttccacataaagaatatgaaaatatgtttgtggaggacaatgatggaggctcagatcacactgcacctctttagtcttccaacttgtatatgcatcataccaaagtgtcttgatccacagcgcaccattttccaaaggagtatcagtgggcagctgacatgtcaccactatggaatatttattctaaactggagactgcagttgtcagcctgtggcaccagggaacagggaaaaatagggtagttgagattgttaaggagagttctaaaacagtttaggaaatcatgcatatgcatttacagtccatgtgatagtgacttttggcaactgcaaagtgactgagacatggcttgctttagaagcatcaaaacaaagaggcatgtgtgttttggagccttttgttgctgttgttcttatcatttggtagccatctggtggtgcttcatattgaatgtgggaaagatgctgcactcaactgaatttaaaaattaaattcttttgtttgaaggttggctgttggatcaaaattgtaggtacctccttgtgttgcttcaggaatgaggcagggatcttcatcaatctgtaaaaaacaagaaaaaaatccttattaggttatgatactatacattatgatgtaagtggaattgactttttacctcttagcaaataattctatgtgaatgctttaaccaactaaaaatattcgagtaaatcaataattttattaagaaatttaacaatttaaaatttaacacgtttcgaaactgcattgttaagtttctgtatctgggacctagatttatttaacctatctgaacatatatcacttatataattactatttcttcctagttaatagattagaaatgaaacaagaactgtttttacaactttaccttataatgaagtttcaaagtatttaagagaaagtgactgatggaatgtctaatagaaatacagtacaaacttatgtcatcctaataataaaaggaaaactcttagtaaatttacatcatgtataggttttcatttacatgaagatacacgctattttaatatctacttacatcatcaccagagaaatactgatctatgatttcaaatgctaatttatatatgtcttcattttcatgttgctgtaaaacttcaattttctccaaacctggtaaaaataaaataatcaaaataactggttaattgataaggagatactaatcaaaaccacactcattttaatcatggagaaatcctaaggaactcagaacacactgctcccccatctaagatagtggtttgtctaaaaaacagacaaaacacggggctgcttctagttggaggaccagaatcccactaattttttccttcttagaagcccttgaggtacccggatccctgaggcagacagtctaaaaaaacacccaaacaatccatttgacagagggaagctgtggcataaatatgtaaagagacttatttcaagttatatggcaagtttgtgacagtactagaaccaactcccccacagtgctttaatataaatttactaatctattttttttttgagacggagtctcgctctgtcacccaggctggagtgcagagtgcagaggtgtgatctcggctcactgcaagctccgcctcctgggttcatgccattctcccgcctaagcctcccaagtagctgggactacaggcgcccgccaccacacccggctaagtttttctatttttagcagagacggggtttcactatgttagccaggatgatcttgatctcctgacctcgtgatctgcccacctcggcctcccaaagtgctgggattacaggcgtgagccactgcgcctgggcattttttctttctttcttttttttttttttttttgagacggagtctcactctgtagccagggctggagtgcagtggcacgtctcggctcactgcaacctccacctcctgggttcaagtgtctcctgcctcagcctcccaagtagctgggattacaggtgcccaccactatgcccagctaattttttgtgtttttagtagagacggggtttcaccatgttggccaggctggtctcgaactcctgacctcgtgattcgcccgccttggcctcccaaagtgctgggattacaggagtgagccactgcacccggccaatcttattaatcttactgcctcataaagtaatttgtatctttctctttgttttccaaatgttattacctttatataaccacaaaatgagtttttagaaccttataattggtataaaagatataaagatttaaattttgaaaaactttctttaaaaaatgaatagaggtcttatgtcctatagccacaatgaacctgggagaaaatatttccagaacagatatcatagaatgccttcatttatatttccaatatatttactccacacatcatatacatgtttatcaatttcacaccttaatattcttccttgaaatgtctttttgaaggttattttaaaatagttgcaattttttcttatatactaataaaccaaaagaatgggggaaatcgttgccaaagtgctttatacaattataaaatattaatatgtatcctattactcctatagacaaaagtaactatattgataaaaagctgaagagtagtaattctctaagttgctcaaacttactgtgttatgaacctgactacaatttttaattatcttaatagtaagaagatctggattttaactttgcttctatcacaacctacttctgtcaccttggacaagactccttaaaatctgtgggataatttcttctcaagaaaccctcccggctgggtgcagtggctcacgcctgtaatcccagcactttgggaagccgaggcgggcagatcacccgaggttgggagtttaagaccagcctgaccaacacggagaaaccctgcctctactaaaaatacaaaaatttagccgggcgtggtggtgcatgcctataatcccagctactagggaggctgaggtaggagaattgcttaaacccgggagacggaggttgcggtgagccattacactccagcctgggcaacaagagcgaaactctgtctcaaaaaaaaaataaataaataaaaaataaataaataaataaataaataaataaataaataaataaataaatagaaagaaagaaatcctcccagtctgaatattctacggtactactgcatttgttttctcttaaaataaataaataaataaacaatagaatattcatataaagtagtcaatgaaatgtaaaatctaaaacatgacattatgataaactaatttaaggtttaaacatgttagtacatattgaacatgtacatttaaaaacagaattttaacatatgtttcacatgtcattaaagaataatacagtatgtcaaatcacaattatttctcattaaaatttcaaagtaactgccacagtaataacttcaggatgtagttgtggaaatcctaagaatcattacaagattgaaacaaaatatctaggtgactcagaagtcagtaaccttttccaactatatgaaataatatttcctaaagtggggtccacagaattacatggtaataacacacaaaaaaagtgtttcattgttaagaagtttaagaaatgctggattaaataaagctttaaaatttatgtagtgttgtaagggctcttaaatttgctgtcatgcactgtgacttcaagagaagtattagtgtttcctaaaatgcaatgtcaggccaggcgcagtggctcatgcctgtaatcccagcactttgggacgctgaggcaggtggatcacttgaggtcaggagttcgagaccagcctggccaacatggtgaaacctcgtctctattaaaaacacaaaaatccactgggtgtggtggtgtgcgcctgtaatcccggctacctgggaggctgaggtgtgagaattgcttgaactcgggaggcagaggttgcaatgagctgagattgtgccactgcactccagcctgggcgacagagcaagattctgtctccaaaaaaaaaaaaaaaagctatgttgtcaatctctagaaggctatacagtgactttcacaacctgattttgcaaagtatggactactgtcttctggaaaatcctcttggaatgcaaatatagtgaataaagaaaagcaacatactgtgatcatttaaaaacaacgtatcctagtaattttctgtctagtaagttgactttaaagaacttatgtttcagagttccagtgctcaaatactcttcttccatcaatccactcttacctccacattcctctattatttcagctattgtgcttgcttcatcaccggccattatcagaatgttttttagaccatctagaaccacctgaaccacttgagaatctttcactgacagtaaattacagaacggtggtattacattctgctgtacaaggtactcaacctagacaacaaaagagaagaaatatttttatttatataattatctatttcccagtagggtgtcgtgctacatggaaggctgaggcaggaggctatcttgagcccaggagttggaggctgtagtgcgttatggtcatgcctgtgaatagcaactgcactctagcctgggcaacatagtgagactccatctcttaaaataataataattatcttttccccaaaaagaacacaatacagtcagcaactacgaaacataagagagcagcatgctttccagtattaacaatcatgacagttacaggttttcaaactcacctgatcttttctgccacttattgttaagttgctgattgcccaagcagcttctttttgtgttccaaagtccccctgaaggttaaaaatgagatcataaaatggactctttatccaaaaagtcttggttattaacagattaacagacacggtgaactcataatatgaccaaccttagcaagctgatgaattatcataggaattaatccagcatctattacagcttgaacttgttgctggttgcctgctgttatgttggaaaggaaccacactgcttcctataattgaacaaaatatagggcacctttatttgaaaaataatacctttaatgtctttctaatatattttatatagacaataacaaaatcacctgaattacgttaaagagactgcacctaaaaagtgattaggtatacaaaatcttccattttaaacaagttataaggaaatttccattaattatatttgggctccaataacctggcatttatccattcattaatatataggcctactataagctaggcattattctaggaaatggtgattttatagaaatgaacaaaacagaaatctttattcatggagcttacatgtctgtgcattagcttcctctaaaagacagaaataaatatacaactgaatttcttttttcttttctttttttttttgagacggagtcttgctctgtcgcccaggttggagtgcagtggcgtgatctcggctcactgcaagctccgcctcccgggttcacgccattctcctgcctcagtctcccgagtagctgggactacaggcacctgtcaccacgcccagctaattttcttctatttttagtagagacggggtttcaccgtgttagccaggatggtctcgatctcctgacctcgtgatccacccgcctaggcctcccaaagtgctgagattacaggcatgagccaccgcgcccagccactatacaactgaatttctaaaactacttaaaaactacttctaataaaggtgatttcttttttaattttaaaaaatatttactcacaagatatagtcattcaagtattccataaaaattaaccatctaactagtctagcatgggtctatataacataaatattctaaaactaagggatttataagtcataaacacgtctgtgagctgtttacaggttagtatcacatgtgtatcttcctcttccacaaatgaatttgttttgccatccaactgtggtaagttgttaataattgctgaatctgtgtttagagtacatgggtgttcactatactattcttgcacattttttgtagatttaaaaagtttcaaacagaaatgctgagggaagaaaatcaagttggtaacttctacttccagggtcctatgatagtctcaaaatgcaagtaacaaattttcaaggcaaaaaatttttgaagtaactaattgcttgctgaagttgagatggcatttctatgaaattttcctctaccccccacgataccctcacttaaaagcatactacatcacaggccggaacctttctctgctgacttctgcccagcttcctcacttctcagttgtttccaattatggaatatattcatttagctaaaaaaaaaaaaatcacctatattgttaaaaatttctttagtaaaagtaactggcccagagtctgaaagtctctggcttctttgtcttcactggaacaaatgtatctataaaatgtgttttttgacaccatacttttctataagaacccaacagtcaaattatactcaagcaactatacaaatatagttatgatgacgaagaagaaatgatcagttctgctgggtttgggtgatggtagtatattaggcagataaaactttagtaaactaaatgtaaatttatttctttttcttttttcctttttttttttttttgagacagagtcttgctctgtcgcccaggctggagtgcagtggcacaaacttggctcactgcaaactccacctcctgggttcatgccattctcctgcctcagcctcctgagtagttgggactacaggcgtctgctaccacacccggctaattttttgtaattttagtagagacggggtttcactgtgttagccaggatggtctcaatctcctgacctcgtgatctgcccgcctcggcctcccaaagtgctgggattacaggcatgagccaccatgcctggccaactaaacgtaaatttaaaccacaatgagacaccacttcacatctactaggattgtcagtaattttttttaacagaaaataaacgttggctaggatgtggagaaattagaattctagtaacactgctggtgggaatgtaaaacagtgcagctgcaatggaaaacggtttggtggttcctcaaaaagctaaacccagaattaacatatgatcgagcaattctacttgcagttatatatccaaagaaattgaaagcgggaactcaaataggtatttgtatgccaatgttcactgcagcattcttcgtaatagtgaaaaggtggaaacaaccgaagtgtccatcaacagaagaatgtaaaaacaaaatgtggtgtatacatacaatggaatatttattcagccatagaaagaataaagttctgacacatgctgcaaaatgaatgaaccttgaaaacatgctagatgaaataagccaggcatgaagacttattacatactagtaagtacatattacacaattaataataaacttgtctatgaagcttgaaatcttaaaaagagtaattttttatgatccttgaatttaggcacctcgtctttgggtccaaactaattttgctgggagatcaaaatttttatgatcggtttgtttaaaaaaataccagcccattcaaatggcagattttgtctgcactttcaagcggctactaatttaatgattgttgctatgctcagtctacttaaatagaaacacaggtagtctaaaaatgttttttactctgtgatgaccagggcagcacctaccagaagcgattaaaagttgaaaaaggctgggcgcggtggctcacgcctgtaatctcagcactttgtggggctgaagcaggcggatcacaaggtcaggagttcgagaccagcctggccaatatggtgaaaccccatctctactaaaaatacaaaaattagctgggcgtggtggcgggcacctgtagtcccagcttctcgggaggctgaggcaggagaatcgcttgaacccaggaggcagaggttgcagtgagccgagatcgtgccactgcactccagcctaggcaacagacagactctgtctcaaaaaaaaaaaaaaaaaagttgaagaaaaacatttgcagaggtgatttaaaataattctcatcttcgctgcagtggcttttaagaaaaacatacaagtagcaatagaaacaaggagacagttaaaaatgagacacagaaagaaatagcataatgaggacattatatgccttaccttatttatcttctcttttgggtgtgataagagatttgggaagtgtgacaggacatcacaattgagaacaacctgggtctgctcgtcggtgccagtcactatgttgccaactgctctgagggctgctgtctagggtggggataaaatgttttctataaatttatttgcttataagactaattctatatttttcataatcctgagaaaaagtaaaaatgcaaggcataaataacacttatttcatcctttcacaaagcaccaagcagtctgagagctattctgaattttaaatagtctcttgtgaaaaactgaaactttatgaaaaaaaaaaattgtgtgaaaattggttggaaaaagattcaaaaaataaaaggaaattaaaattttagaagaagtccagtttcttaaggctgggcatggtggctcatgcctataatcccagcattttgggaggccgaggcgggggggatcacctgaggtcaggagtttaagaccagcctgggcaacatagtgaaactccatctctactagaaatacaaaaattagctggtgtgatggtgcatgcctgtaatcccagctactctgaaggctgaggcaggagaatcacttgaacctgagaggcagaggctgcggtgagcagagatcgcgccaccatactccagcttgggcgacagaacaagactccatctcaaaaatatatataatattttaataaacgcctggaatgggcacacacttccacctagaaagtcactttggtaaagcaggatgaacagatctaataagtgcctacccctaattagagtgggagagagaaagaagaaatgcaattaggttattgcaattatttgggggaaagatagagtcttgaactaaatctgttgttctagatagataaggagagacagatttgaacctatataagaagaattgaaatgattttgtaatggaatgggaattgcaaggaggaatcaaaatttctagcttaggccatgctgttcactgaaggtagacaaggaagaagagcaggtttgtgggagatgatcgtttcatttctgtctagttaaccacggaaagcttgaaggagttcttagatgatatgtataaagggtcaagaacaattggctatacaagtgtggaactcagcaaagaaactgggtgagataaagatttggaaatcaacaaaatcaggctcagggactagcagaagaaatgtggaagataagcacttacagatagaattaaagcctagctgtacaagttaactggttatagcaaacacaactgtatacaaataagaaaaatttaaaaatacttacttgaactttgacttcctgatggctcagaaggggcacaagaaagggcacaactcctgaatcaataaccatctgtatctgttcattacctccatctgtcaagtatgacagagcccaaacagtgtctacaagaatctacaggaaacacaaaagaaaaaccattttacatatttgtttgaatgctttacttgttcaacacacctcaggagtagtgacagaaaaagtaaccaaatttcaagttttagcttagtggcaaaaatatctgcttagctgattaatctattaagtagaaagtaccttatctttctttcagtgcctacctcagatcattcttcacagaaaatgagacacagaagtctgggaaaacttctattccaacttctgcatttatgtatcagacagatgaatttaaaaacaggcagaaaagtaattctccctgccctcacaaattagctacctaataatcccacagaaaaacactatttacaagaatgaggccaacacaccatactgtttcaagttcagaagagaacagaaaggtcatctatttactctactggttttccaacatatttagcaatacaatttttcaggctactaaagtaaaccaataaaagaaatgacttggcactttaacttcatctggggaaaaaactgtttgaaaatctcctgaaatgtgtccccaactgaagtataaacctggagtataaaccatgccctaggcctatcctaactttgcaactacatagaagaaaacaggcttagcgatctggtgattcattcaaggtcaaagatcttgtatgtggcattgcttggtgtcgtcacagaggaatataagcactggttgtagcttatgcaaaatcaagatgtttcctattaggtcatccaaattgaagacatcacatctttttgccctaaaataatagcaggcacctgaattcacatacccttcaaaaaaggatatagatgaataaataaaatagaactacacatataacccacaccccttcagcattactaagagtcagagaacactaaaaatttccattatctgtaagaggagaaaaaattaaattctagcttttgtctggacctcttgcctcaagactgtgtaaaagagaggacagaagctgggcctaagagctgagcccacctaccagcccatttcccactctggaagtgaggaggcctccctgctggaggtgtctgcagatgctgggtctgagaacaaagtctggctactgcccaccctggcagtaacagtaactagatttacctagaaacaggggtctcaaagcataacaccaatatgtgtaggctacaatggaaaataacccttcataccaagatccaggaaattctcaaaagagaaaagacagtcaacagatgccaatattgagatgacacacatattggaattatctgacaaggacttgataagattttaaagtaactatcataaaaatgcactggtgaacaattatgaacacatttgaaacaaatttaaagtgggaattctcagcaaaaaaacccgacatgatagaagggggaaaaaaaaataaatgaacccaaagatacatcaatagaaatcatccaaactgaataacagaaaaaaaaaaagattaaacagaaattaactctcaggaacttccagcacaataacaatagatctaatatttgtgtcttcagagaccctacaaggaaaggcggagctgaaaaaaatatgaagaaatatgttccaaatttggcaaaatagataagtctagaatcagattaaaaaatgggaggttgaggcaagaagagaaaatagaataagctcatgcatcattgcacaggtaagagacagaagtaaaaaaatatatcatttaaaactgtcaaaacagatagtaagagagcattaaaaaggtgtaagaataaaggtaaccactagaacaaaaatacaaacttccccaaataccaaaagaaaattgagaaagacaaaagtatgcttagcagagaaaaaaaaaaacacagggacattatttcacaaaatgacagttcaaatcaatctatcaacctatgtgaatgggcctaactaacctattaaaaaaaaaaaaagattttcaaattggccctggctctcaaaacaaaacccaattccacgctgtatacaagagacacacataaaacaaagaatttggaaaggctaaaaataaagggatgagcaaaagtatgccaagtaaatgataaaaagaaagctgaggttgtaaccctgttaaaagacgaccagtagaatttaatctaaaaagaattacaaagaaaaaaggatactttacaaagttaaatcccacaatttatcatgaaaatacaacagttataaacatctattaaccaaatagccctgcaatcactgttttaaagcagagaataaacacacacacacacacacacacaaatatatgtaaaaacatactaataataggaggttttaacatactactgtcatatgagggaagtcaaataggcaaaaaataaaggtataactcttatgaatatatattgaactttataccctgataatggcaactacaacttgcacatgtacaaatatcatattaggttcaaagaaaacatcaataaattacctaagtcagaaacattataagcctatcacaaggcaaaaaacttatacattaataaaatgaaaaccaaaaaggcttttctatatagaaatttaatagccttatattaaacagctcttaggtgaaacacacacacacacacacacacacacacacacacacacacaaaacagaaaaacccaacaacaaaatttctatttttcttttctttttgagacagagtctcactctgtcaccccggctggggtgtagtagcacaatcttggctctctgcaatctctgcctcctaagttcaagtgattctcctgcctcagtgccccatgtagctgggattacaggcgcgtgccatcacagtcagctaatttttgtgtttttagtagaaatggggtttcaccatgttggccaggctggtctcaaactcctgacctcaggtgatccacccgcctcagcctcccaaagtgctgggattacaggcatgagccaaaacgcctggcctaaactcaacaaaatttctaaaaagttaaaacaaaaatgccacacatcagaatctatgacatttatttaaaacagtgattaaaggaaaattcatagccttaaaaatttatacaaatttgtctgaacccatagaatgcacaacagcaagagtgagtgaacaacagtgtaaactacggattttgggtgattatgatgagtcaatgaaaaatacaaaagtaatgagataaagaatagaaaaatcatagatctaactaataaactgaaaccctggttctctgaaaaaaacaaaaaacaaacaaaaaaacaactaagaaaaagtcctacctaacttaattagaaaagagcagggagggggcacaaatacacaaaatcagaaatgataaaataacccttaaaataataaattagaacaaaaaactaccctgcacactttaatgcaagtaaacatagatgcaatgaataatttactagaacaatagtttataaaaactgaccttctttagaaagagtgcttaaacaagccaacttccatatcaaaaataaagaaaattatcatgaaactaactccacaaaaaagtaccaaatccccaaaggatttaagagggaaactatcaaatcttcaaaggtcagacagacttgatgctatataaattgttccagagtacagaaaatgaaggaagcataacattaacacctcaactttaataaaacaatagaagtataaaacttaatacatcatgattatagcaccattaactaatggtattaacataattaaatttaatattaatatttgtaattaatgtaaattattgcctaataaattgaacaaaagctaaactgcaaaccaatatcacttacgtgaatgctgatgtaaaaatctgaaataaaatattattaacagaatcacatactacattgagaaactaacatataatgatcaagtgagatgattcaaagaatgcaaggatggttcaatttttaaaaatatcattaatataagttttattaatagatttaaggagaaaataatagaattttctctacagacactgaaaaattcattacattttttcagtgtccttgatagaacacccaaaaaaggaatgtatagatatttctctaacataaaacatctatagttcagacaaaatgtagatacaattaaaaaaaattgatgaatttgattatatacaaaaagttcacatggcaaaacatcatagtcaaagacaaaagacaaactagggaagtattttaagtatggcagaactaatatccttaatatataaagaactcttaaaacctaagaaaaagaccaaaaatcctacagaaaaacagacattaaatatgactagtctgttcgcaaagatacaaattaaaatggcccttaaacaaatgaaataatgttcaacgtcattcataaaaagtaaaatgcaaattaaaactgagatactgtttctcacctatcagatgagcaaaaattttaaatgtgacaacacactctattggcaaggatactgagaaagtcactttcacttttgaatgcatactgcatacactacataatagataaaggagtcgaaaaatgtcatttaaaactatcaaaacagtaaaaaagaaaagatataagaataagggcaaccacaataaaggcaaccactagaacaagaatacaaaccttcccagataccaaggcaaaatggcacaacccttacagcagggaatttggcagtatgcaacgaaattacaaatgcatttactctttgacccagcaatcctgcttctaagaatataccctgaagatatacctccaataatatgaaaacacacaatagtcattggtataatacttttacatttgcaaaattcaggaaatggcctaaatgcctatccataatagtgtgtttaaataaactgtgtccacaaaacagaatcctgtgcaaaacaacatgatgccttaagatgtttctccattacatggtcactactattagcagaaaactatttttttttctaactaatataataatgaaattgtagactgagctcaactaatggttttcagtggggtctccatgacaatatctcaaaggctgggagaagataagctacagctgggtgttaggcaccctgaaactgcaaatacttgtagtctctaattttttatttttagagatgaggtcccagtatgttgcctaggctgggcttgaactcctgggctcaagcgattttcttgcctttgatctatattagcctttgagctatcaacctaaaaaaaaaatttgaccatttattctctggctccttatctactacataaaaagggtatgtagttctttagacaagactatatgatctagaacctattaaatctctgccttattttttccccactatttgttccacattttatgcttctatcacactttaattttatttaattatttttttttaacacagcatctcgctctgttgcccacgtgggagtgcagtggcgtgatctcggttcattgcaacctccacctccccgactcaagcgattctcctgccccagcctcccaagtagctgggattacaggcacgcatcatgatgcccagctaatttttgtatttttagtagagacggggttttgctatgttggccaggctggtctcaactcctgacctcaagtgatccactgtcctcagccttccaaagtgctaggattacaaatatgagccaccgtgcccagccatcatcatactacttttaaaaactcctttgttggttcttcttcccttgctgccattcctgaaacgccaggaattcctaagttacatttttagccctccttccgaaatacagcctcctccaggtgatctcattcaatgcccaggttttcatcaatcccttaaatactgacgaatccaaaatctgtattgtcttttgcttttggaaaataccgccactgaggaacaacaagttccaagttctactcactttatttcctaacactcaaagttttttctcccttaacgattcctattattgcaatttagtaatagtccatgccttcatcaacttccctaaacctattatgatagcaaaatacatctacctacagtcaaactttccctacttcaaaccttccatatttgtgttatttgtctgttacagataattttatctgtataaaacaaatatcatttctcgatttaaaaaatctacaatgactctgcagtcattacaagataaacttaaaactctttaatatagaatcaaaaactcatataaaaaattagcagggagtggtggcatgcactgtaatcccagctactggagaggctgaggcaggagaattccttcaactcgggaggcggaggttgcagtgagcctagatcgcgccactgcactccagcctgggtgacagagcaagactccatctcggaaaaaaaagaaaaaaaaaaaaaaaagaatcaaagactctgcaaattaactccttagcgaacgtattaggttattatctacatgtattctcttaaacctccatgtattcttgagttcttaatatcttcccccgtgttcttgaaatgactttctctcaacctgtgaaaatcctattcatcctagttatatgacatgagacaaattacttaagtacctctgcttcttttacaacgtttgtagatgatggagataatgagagtaccaatctcacaagaattttgtaagaattaaatgggttaacatagcaaaagtgcttaaaacagtgcctggcagattttaaactcaataaatggtaactatgaacactataatctttgactctgtccccacttctgtctccttataatgctcgtctcaaatgttactttgtcaacgaagctttctgcttcgctagcaaaattatctgtgcttccataataaagcactttggtcactgctctatcttaccttttttcttgttggctttcataccatgttttatgtttatgtgcttatggtatgattttttttttcactgtgagcctatggattatactgaatatgtgatcatggtatgaaaaagcacaggccttggacctggcttcagttctcaggtatggctctcattcattgcatgaccttagaaagattatttaactttaccgagtttcaatctctgtatttgtaaaatagaagaataaaacttatcttacaaggatactggtaagataaaaggagtctacagagagatccagcacagcaatttcttgacataagttctttccttttaactctttttacatctttaatgttaaggtcttagaaggcatggtctctttatgtcttatcactgagtgtacaattcatggcacaattctggctttaagtggaataatttgtgagtgtttgctaaacttgactaatatacctgtaactacagtacactgccactttaataccccagctttcacataaacacaaccaacagatggtgaaagcttttatttgcctataattaattctataatgttctgggggaaagtcctgaggcaaacagcagatattttgcttattccccttttaatctttgctgtcagaaagcttacaactaaacttacctttcaacagcaacaactaaacttctgtataaattttactttttcctttacagatattatcttatatgtcttttgttaagtcactttatatccattttggaaataagacggcatataaacatgttttacttcattttaatgacattttaggctgtgtcaaacacgaagtgactttagctacctttaaaagattccatcctgagagcttaaaatctgcaaatgagctagagtaatgtgatacaatttttatatacaaattatattgccttgtgagaaaggtaagcaaagatgtatttctttgtcccaatgataaattacacacaattcacaattctgccacacatatacacatatgtatgtacatgttatgtgtatgtagataaagattacaaaaacacaaatatacaacaaatcagaaagagatgttagttagaataaaagaaactggatcaacactagtcaccgaaatttatccactgttttactccatggaaaagtaacaatttaccttactgcatttaggagaattttcagattgcctagatagtatcaaacttgccagaacgttgacagtaaatgcttcactaaatctgaatataatgaaaaaaaatcacctaaaaatgccttgcatttaaaactatatattcttctatactatatctaaaaagactgtagcataaaaaggcagcatggttttgtgacaagtacccaagacctgttatgagaagactttaatttgaatattgactctgacccttactagctcttccactttagataagtcatttaatctctctctgagagtccgtttcttcttattctataaaatggggggaataatatctagcctatctgttgtaagaaccagtgagattttttttaaaaagtaaggtgtttcatgaggttttaccgctttacaaatattaaggtttaaaaacactacttaataatgacagaaataaactacatatgcagtaatttctcaaaagtgagcatttttgctgtctggctgttactgcttacagatttaagctataaacctaatttaagcttaatcctatttctgaaaactgtaaatacgttgtagaaacttgacaagttgataaaatgtatgctgacacttacataaaaaccctttctgtcccatcaagagcaaaatcccacatttaagctgcttcttaacttacgtttatatctgtatggtatatgaggacacataaagctggcaaaatctgaggaaagaaaataaacaatacttaacattagttaattaatatgtctgtaaaaatgaacaactttgacataaaaagcggtaaatatggtttgtagggcgagaaagacaatgttaaatttgtctgaatatcttttaggaaaatgaaaacctgataaattcaatctaaaaaaaccaaaaacatatctcaaatgttaaactgaaatatgttcaattaacaagttaaaatatccaaataaatctggcagaagttaatgtaccttaaaataaaaacatttgtttttaataaccttctttatggcataaaatgtcaagtggaaaaaatggagatgcaaatatacagttacagctatttaagaaaagctacacttaaaactgccgtaattgtctcacttacctgcttaacgtaaaaatacgattttacttaataagctacttaagtcaaattaaagttttcaacttcacctttagtcaagaaaattcgaaccagtacaaagtacaaagctttgcttgttaaattcaggccccagagatctctttttaaaatatgggagaaagggagcagggggttgtaggaaatcacacaaaatacctttgcatagcaacaaaaagtagcaggtactagagaaagatgtccattataaagatacacagttggccaagtgtggtggctcatgcttgtaatcccaccactttgggagggtgaggtgggtggactgcttgatgccaggagttcaagaccagctggccaacatggtgaaaacccatttctactaaaaatacaaaaattagcctggcatggtggcacatgcctgagacatgagaatcgcttgaaccccggatgtggaggctgcagtgggcaaagattgtgccactgcactccagcctgggaaacagagcgagactgtctcaaaaaaaaaaaaaaaaaaaagagataacacagtcaacagtgaataaaggttatgtaggatttttttttaaaatgcaaagcacaaggatctatttacatatcaaatgtaaataaaaaagtttttactttgttttaattagtagatttaacaaaaaatatgtcacacttttaagaactccaattttgtcagtaataaattggagttaggccgtgggggcagtggctcacacctgtaatcccagcactttgggatactgaggtgagcagatcacttcaggtcaggagtttgagaccagcctggcctacacagtgaaaccccatctctactaaaaatacaaaaactagccgggtgtggtggcgctggcctgtaatcccagctactcaggaggctgaggcacgagactcgcttgaacccaggaggcagaggctgcagtgagctgagatcatgccactgcactccagcctgggcaatagaacaagactgtctcaaaagaagaagaagaagaaaaaaaatcaattggacttaaagcaaactcattcaagaacatttgcatgtaagtatactagttttgcctgtagcaacccccttttatagctttaaaccaacaatgcaatacagtaataaaactttgagattgttttccttttgtatttttctctctgaatttttatattttctttttatgcagataatcaaaaaaataggcattaggatgaactgacattctttcaggtacagtaagacactcaacttttatttcataggagtaattaaatatggtacgttacttttaaaatcttacacctgtggctgggcgtggtggctcaggcctgtcatcccagcactttgggaggccgaggcgggcagatcacgaggtcaggaggtcgagaccatcctggctaacatggtgaaaccccgtctgtactaaaaatacaaaaaaattagccaggcgtggtggcgggtgcctgtagtcccagctactcaggaggctgaggcaggagaatggcgtgaacccaggaagtggagcttgccgtgagccaagatcgcgccactgcactccagcctgggcgacagagcaagactccgttatcaaacaaacaaacaaacaaaaaactcacacctgcaatgaaatcagtatatgtattattttgtcccctgtatatgaattcctgaagtacaaacatagggaaaatataccatctggcctttacaattcttcatttacctcctgaactgtctccataggcggcgggggatccttattcctgcagagattgacaatgacccatgtgacgttccgaaggaaggtgatggggatggagggactgatgaaggacagaagaggtttgacaactcccagtgatatgacataatctctacattgaggaccatcacctacagaaatgaaaattatatttaaaaaaaacttacattcaggatgagaaagtctgaaatgtatgcaatggctcatgtgggaacactgacgttctatgtttcctcaccattagtcaaaggcatcaagtgttgtttctccagattttgatctggggaacgtaaatttaacctaccaatgctaacagcaaactgtatatccttttcaaagagcatcatcttaagtcagtacttatgaggcaagaagagagtcaacacacattaaattcagaggaaacatagtatgtaatggctatgccaatgtaggaaaaaagttaatttagattcttaagaggattcctttcaaaccacttacctataatgtttcccaaagcccatactgcttgttcacaaacattctgatgtggtgaacgaagaagtctcagaaaaagaggtactgcatctgtaataaagaaaaactaatatttatactagcaacatgttgaagagtttacagatttcagatcaaagaaattgatcaaatacacagcctggcatattgtagctggaagaacaaatgtggcaaatatctttaccctaaaaagaatcaatttcagtattttcccctagtaatagtcaagtaccgtaaccaactggcagtatctaaaggttgctatcataccattaactaaaagaaagcaacagcatgaaatccttcctataatccattaaaaaaaaaaaaaaaaaaaaaagagttcctaccccaaacatgtaaccttaaaatgtaatgctttagtctacaaaatctcaattcctgatacggggattaaccaaagaactgattaatctcatatcaggtctatcttatactttaaaataatttctcataatccttactctttacagaatgtatacattatacccatttccagcataagctagatcactttttaaaaatttcaatcaactgtgcactacctcatttttttttttttgctgtatctgtgtattacttgtattatttacttaaaatttaaattaattcagttttaacaactttacggagatataattacaataaatttacatttaagtgtgtaattcaatgacatttcatatttatacagagttgtgaggacatcgccacaatctaattttataacatttccaggacctcaaaagaaatcttggctgggtatgatggctcatgcctgtaatcctaacactctgggaggccgaggcagatggatcaccaggtcaggagttcaagaccagcctggccaagatggtgaaaccctgtctctactaaaaatataaaaattagccgggcgtggtggtgggcgcctgtaatcccagctactttggaggctgaggcagagaactgcttgaaccagggagacggaggttgcagtgagccaagatcgtgccactgcactccagcctgggtgacagagcaagactctgtctcaaaaaaaaaaaatatcatactcagccgggcacagtggctcacacctataatctcagcactttgggaagcgaggcgggcagatcacgaggtcaagaggttgagaccatcctggccaacatagtgaaaccccgtctctactaaaaatacaaaaattagctggacatggtggtgtgtgcctgtagtcccagctacttgggagggtgaggcaggagaattgcttgaacccaggagacggaagttgcagtgagctgagatcacgccactgcactccagcctggcgacagagcgagactccgtcttaaaaaaaaaaaaaaaagaaaagaaaaaagaaaaaagaaatctcatacttaaggcagtcattccacatttgttcctctgccacacattccccaagcggcaggcaaccattaaatatctgctttctgtctttacagatttgcctattctggacatttcatacaaatgaaatcatactgtgttttttggggggtctgacttcacttaacattcttcaggttcatccatgtggtaacaggtattggtacttcattcttttttactgctgaattgtattccattgtatacaccacattcactttatccactcctcggttaatgaacatttgggttagttatgaataacattgctgtgaatatttatgtacaagtgtttgtatgaatatgttttcatatctcttggtttcacctaggagtagaactgctgggtcacatgataactttttttttttttttgaggtggagtctcgctttgtcacccaggctggagtgcagcggcacgatctcggctcactgcaagctccgcctcccgggttcacgccattctcccgcctcagcctcccaagcagctgggactacaggcgcccgccaccatgcccggctaattttgtttttgtatttttagtagagacagggtttcaccatgttagcaaggatggtcttgatctcctgacctcgtgatccacccgcctcggcctcccaaagtgctgggattacaggcttgagccactgcacccagcctttgtttttgagatagggtctcactctgtcgccggggctggaatgcagtgtgcagtctcggctcactgcaacctctgcctccctggctcaagcgatcctctcgcctctgtctcctgagtaggtgcgactataggcatgcgccaccatgcaatgctaatttttaaatattttgtagagacacgattttgtcatgtcacctaggctgttcttgaactcctgaactcaagtgatctgcttgccttagcctcccaaagtgctgggattagaggcatgagccacctgtgggtctggtgagaatagtattctcaatacatgattcaatgtaacttactgccatatcacatgctacttaaaatcaccttgattaccacacctaaaattagctaagtgtcccatactataataacgtacgtggtgatatctagtacttttctaaagagcttgtgtcagtgtcatttaacaataattattagcccatcttgaggaaagtaaaatttaaaatatgtcataagctaaaaggcagaagccattcagcatcttgaagatatcagaaacggaatttaaaatcctgttatcacagcatgatgtctactccaaaagataaaactctactcttcttttaataaccacaattaaaaatttttcatgataaattaatgacggctatgaaaaagatatcggtcatcaaaagtaacttataaaagtcatcatttaaaaaatgttacaagataaaatttctttattacaaaactctacttccttgccatcattaaaacacaaaaagttcagacagtaaggaatttacttactagactgcacaacagcttgagtctgtgcagaagttcctgatgctatgttagttaatgcccaagcagcttcaaactgtaatgaaggactgtaaaaaaacaataacacatctttttagacacataactaccacttaattaatgaatcttaagactgataagatatggctattctttgccttgtccttgaatttcaccttgttataatccaattgcctgctagccaaccctactttttttttttttttgagatggagtctccctccatcacccaggcgggagtgcagtggcgccatcttgactcattgcaatctctgcctctggggttcaagtgattctcgtctccacctcccaagtagctgggattacaggtgcacatcaccacacctggctcatttttgtacttttagtagagatagggtttcactatgttggccaggctggtcctgaacccctgacttcaggtgatctgcccacctcggcttcccaaagtgctgggattataggcatgagccactgcacccagcagccatctctacttaaaaaatctctttggctcccaaagccagtcactatgaacctgcttctttatgtccactggtattacaacatttagccagtcattatttcccttgacttcgacttcctctccacagacacatctaatcaatatatcatgtcgattttacctcttaaacatttcttacatttatataatcacccctaatatcaagtgctagttgaggccctcatcatctcactttaaccactatcacacgctctaggctggtcttaaagctagaaccccatctgtctccattacaccatctgctttacatactagggatattacaaggctgtataattttgttgaaaaaacaagatcattatattttcgaatagtaatggaagacctcacaaagaaagtgacaactgaactagcttttcaaagatggatttaaaaagaaaggcagtgacagtgggaaataaaacaggtatcatgcatggaaggatcatgatgtgtaggaacgacaaggattagatcaagagagctgaaactaactaagaagcaagtaacagggtgtttgtgcatgtgtgtgtgtgtttcaggatgggagtgaggagtgtattctacagatatgctaaggatggggcattgaaaaagggaggaaagaaaataatgttcaaatcaatggtatgcagaatggctaaaaaaggttaaaggctgatataggagagacctattaaaagacatgttggggcttacacctgtagtcccagcactttgggaggctgaggcaggcagatcgcttgagccaaaaagttcgaaaccagcctgggcaacacggtgagaccccatttttacaaaaaataaaaaaatcagccagatgtggtggtacacacctgtagtcccagctacttgggatgctgggcgggggtgggatggggggattgcttgagcctaggagtttgaggattcaatgagctgtgattgtgtcactgcactccagcctgggtgacagagtgaaaccctgtcacaaaaaagacataaaggaaagacctgttaaaaggaaatgatagatattaagttaggatagctgaaagagtacaaattcccttaagtggaataccaaggattggggggatttagtcagcaaaaattaagattagacaaaggttagggagtttgaagaaaagcctataaacagggaagagagcaagcaaggttgttagtatcaaaaggttaaagaagtccgggcaaggtggttcacacctgtaaccccagcactttgggaggccaaggcagatggatcacctgaggtcgggagtttgaaaccagcctggccaacatggcaaaaccccctctctactaaaaatacaaaaattagctggacatgatggtgcgtgcctataatcccagctgctcgggaggctgaggcaggagaatcccttgaacccaggaggcggaggttgtggtgagctgagattgcaccactgcactccagcctgggcgacagagagagattccatctcaaaaaaaaaaaaaaaagaaagaaaaaagagaaaaaaggttgaagagatccaagaacaaaaggttttaaggagaatagatgtcagagatatagcaaatagtgatatacaggttaaaaagatggaacatatgagaaaatgaagtagcagagaagaactatgaggggactttaaaaaactcattaaaaatgtgtattatgaaaaaaactccatggatttcaatttttttgcaccaaaataaactcatactaactttctatacacgtctgaacatgatctagtttgaggcactaagaggggtaaggggtaagtcatcaatctgaaaagagcccctagaagagcaacatgaatcctgctaaaattaaagcaaaaacaaacatcaaatttatggtgaagcttgggtgaaataatggtgaactcactgatgtacttaaaactttacggggaaaatgcccccaaagaaatcagcggtttacaaatggttaactccttttaagaagggacaagtcggccgggcatggtggctcacgcctgtaatcccagcactttaggaggctgaggcaggcggatcacgaggtaaggagatcgagaccatcctggctaacacggtgaaaccccatctctattaaaaatacaaaaagtcagccgggcgtggtggcaggcacctgtagacccagctactcgggaggctgaggcaggagaatggtgtgaacccaggaggcggagcttgcagtgagctgatatcgtgccactgcactccagcctgggcgacagagcgagactctgtctcaaaaaaaaaaaaaaaaaggacaagtcgatgttgaagatgaaatccacagcggcaaacaatcaacaacaatatctgaggaaaagattaatcttggtcgtgccctaacagaagatgattgctgattaacagcagaaacaataaccaataccagacatcttgattggttcagcttacaaaattatgactgaaaaattaaagttgagcaaactttccccttgataggtgtcaaaaccattgtgcccagataagccgtagacaacagcagagcttccaatgaaaattttaaaccagagggatcaagatcctgaagtatttcttcaaggaattgtaaaaggagatgaaacatggctttcccagtatgatcctaaagacaaagtacaatcgaagcaaaagtggactggtcaggaggaaaggtaatgactaaaaagtttttggggatgctcaaggtattattcttgttgaccttctagagggccaaagaatgataacacctgcttattatgagagtgttttgagaaagtcagccaaagctttagcagaaaaaagcctgagagagctttaccagagagtctttctccaccacaatgtttctgttcattctgctcatcaaacaagagcaattttgcaagagaatcaataggaaatcattaggtatccaccttacagttctgatttggccatcttgtgacttctttttgtttcctaatcttaaaaaaacaacctgtaaagggcatctagttttcttcagttaatatcatgaaaaagactgcgctgacatggttaaattcccaggaccctcagttctttagggatagacaatggctggtagtatcacttacaaaagtgtcttgaccttgatggagcttatgttgagaaatcaagtttatatatttattatctttcatatattttattgtcttttgattccacttttccacaaacttttaaaatttcccctgtatatgatgaattctagcagaaggcaggaaataagatggtatatcagaggcagggaagaagtaaaaaaaacagtaagatcaaaaacagtaagacagtatatgttgcctcagactggaaggagaaagttattaagctggttaggtggtttggcaaaatactgggaatgggggacttaaatgagaaaatggataaatgtaaaaaataaaattataaagccaaagaaagtctttcaagatgtcatgtggaaaaataaaaaaaaatgagaaaagatatagaaaaaacgagtgcaataacaaatggacatttatggccgagtgcggtggctcacgcctgtaatcccagcactttgagaggccgaggtgggtggatcacaaggtcaggagatcgagaccatcctgtgaatggtgaaaccccatctctactagaaataaaaaaattagctgggcgtggtggcaggcgcctgtagccccagctactcgggaggctgaggcaggagaatggcgtgaacccaggaagcggagcttgcagtgagccaagattgtgccactgcactccagcctgggcaacagagcgagactcggtctcaaaaaaataaataaataaaaataaaaaataaatggacatttatcataagtttgacattgtgtagagtgctttgtatgtattatttccattccttaccatcacctaatttttatagatgagatagctgaggttcaaaagccacgtggatttttatcaacagcaaaccctggatttgaaccacagtcaatctggctccaaagtatatggccttttacattataacacaacttcccatgacaaatccataaagtcagatccaaatcacggaaaattttctgtttttgctttgggtggtggttacagaggtctgagtttcataattattcattaagctgtatatattttagcatatttttctgtattatatgttatgtttcatagacacagacacacaaatgagtctacatataaaagactggaaagaaaaggaaaaaaagaagaagagaagttggccacaaacaaggggccctaggccgggcccagtggctcatgcctgtaatgtctgcactttgggaggctaaggcaggaggatcacctgatgtcaagagttcaagaccagcctggccaacatggtgaaaccccatctatactaaaaatacaaaaattagccacacctgtaatcccagctactcaaagaggctgaggcatgagaatcgcttgaacccgggaggcagacattgcagtgagccaagattgcaccactgcactctaccctgggcaacagagcgagactctgtctcaaaaaaaaaaaaaaaaaaaaaaaaaaaaaaaaaaaagaacaactggagggtcctaaaggtagaagtagaatagaacttatttatttatttattttattttatttttattattattatactttaagttttagggtacatgtgcacaatgtgcaggttagttacatatgtatacatgtgccatgctggtgtgctgcacccattaactcgtcattcagcattaggtatatctcctaatgctatccctcccccctcccccctatttattcatttattttgagacggagtcttgctctgtcgcccaggctggagtgcagtggtgcgatctcggctcaccgcaacctccgcctcccaggttcacaccattctcctgcctcagcctcccaagtagctgggactacatgcgcctgccaccacgcccggctgattttttttaatattttttaatagagacagggtttcaccacgttagccaggatggtctcgatctcctgacctcatgacccacctgcctcagcctcccaaagtgctgagactacaggtgtgagccactgcacccagccgaatttattttttgagtcagggtcttgctctgttacccaggctggagtgcaatggcatgatattggctcaggacaacctccacattccaggctcaaacgatcctcctacctcagcctcccaagtagctgggactataggcatgtgccaccatgcctggctaattttcgtgttttttttttttttttttttgtagagctgggatgttaccatgttgcccaggctgctctcgaactcctggactcaagcgatccacctacctcggcctcccaaagtgctgggattacaggcgtgagccactgcgtccagccagaatttattttttcaacagctaaaataaaacttacctttacttaagtaacactgttacagaaaacaaacatgatagtattttaaaaagtgttacaggcctgggggtggaaagtgggagaggttgtggcacacaacgaaagcaaatggtatttttaaatactaaaaacccttagtggcaacatttatataccactattcttatctagccaactgaaaattccttggacaacatttagcaaaatatcccaagtttcagtctagatgctcttaaatgcaaaaaaaaagcatttgttttaatatgttttggagttcaaacttatattctccccagttaatccaaattaacaaagtttaaggcacagcactgagatatcactaaacaaaaatggaaatagggccagttcctcaaaagatatccagtggagttttactccttctctcctgggtaaatataacctgtccccttattcttaatttgcagcaaacaaaaagtctgacattggacaacttatcatggatgaagttctgttaaagacaacacagaggatcagtaatcagctggaagattcccagggtaagaaagagccacttagttctggaaaccatccatgttgacttagtcatgaggttaatctatatataggctcataagcaaagagtgactcaaacattatttgggttgttttaaaatattagtaataaaaaatcctaataaagactataaatatttgagataagttaaaacaggcaataaacaggagataaaaatttcctagaaaacatacacatccttcagaaatgaaaacgagaagcactctgggtctgctaaatatgatcacagaataagaaaattaaattaaaatatatgacgattgaaaaacatcataagtacaaaaccaaactgaactcactggttaagtaataatccaaacttttaagttaactgaaaaaaactgaatagggagtaaaatccatacttacttatcatccctttctagacatttgactagaattggtaaaatcccagattttattaagtcatcaatcggtggatttctgtcactggataacagttttctaggaaaataaatatgagaaattaattgctataattttcaaactgtgaaaagaaataacaacatattaacttctagactaccaggtaacacaactgaggaatgacataattctctctctagacaaattagtatttaccttgctgcctggacagcactcaattggaccactgggttatcacttgtggcattctgcaataccaaatgtaaatttcagaaatgaaaaaaaaaaaatcaatttcaaaatacttcaaaacgagagtattaatttagtaacatacctgcaatatagcttctagggttacattttgcttaaaaagaaaaaaaaaatagttcagcagagtttattaacaaaattacattcattaaacagtgtacctgagttaatatactttcattatcattataaagttggtcttatattaaaaatgaagttctcacagttactataaaaattattttaaaatcactattaaaacatggtaacttactgctttaaaatcagcatcaacatctgaatcttctagactttcttcttggggaacatttctctttttcaataagtgttcatctcttttgttctgaaaggcaaccaataaatgcttaagaagtcataaggactactgttaatgaaaaatccattaaaactacttcaactttattaggcaattatgaaacaaatactgaacacataaggataatatgaattaaatgtgcatactgcaaaccaatgacaagggtcacattctggcttcggtaacaaaatttcctggctggcttttacacacacacacttcattaagcacccactgtggtgtttttttttttttttttttttggagacaagagtcttgctctgtcacccagtctggagtgcagtggcacaatctcagctcacttccaacctctgcttcctgggttcaggtgattctcgtgcctcaaactcctgagtagctgggattacagtcgtgcgccaccacacctggctaatttttatatttttagtagagatgtgtttttgccgtgttggccaggctgatctcaaactcctggcctcaagtgatccgcttgccgcggcctcccaaagtgctgggattacaagcgtgagccactgcgccttgcctatttgcgtaagtttgctcatacttaaattgtagattgtttgcaaaaatggcagtaattccccttcccatatccagtcccgcactgactgtaggcatggctgtgtgacttgctttggcaatgggacattaagcaaacagacttgaaaagtgcttacacatcagggacaggttctcttttgcaacttttttcctgaaatcaccttgtgaacactgagccatggagaataagactgtgtggacaacaaacaagtcccagccaagttacctgagaccatgttagatcatctagtcaccaaccaaccctgtcagctgaccagagacagtaagggaagcctgcagaaaacagttgaactggcctgtgccagaaaacccactctgccaacccacaaaattgttagctcaataaaatggctattgttttaagctacatagtttggagtggtgtattatgaagcaaaaaactagatgatgcactcatgtttttaaatttatgctgtatttaaattaataagacttctaaaattcctggtattttgttgttgttccttctctctacttgctataaatttgtctcctgaattaccactttaactgtattctacaggttctgacatataatagttttcctactgttcatttttaggtattcctagaatccattaagatttcttttatactcaatatattcaatatattcagacatactttaaaacgttcacaactatgaggtttttgtaactgtcttattcagtgatttctaatttaattacattgaagtcagagaacatgtatgtacaatacactgaaattagctgacatctgctttataccagaagttcccaaactttctcagtccacagtgtacgccaaagtagtcatttgggaaaaagaaaagaaaaacaaataaactaaaagaaaaaattatttcactcttagataaaataattgtagaaaggaatgtagtgttatttaagtgtttaaactgtggactacctcgagatctaatagttctgtggtgtctgaaagatgtcactgtatttctctcaaaactgaaatatcccaaagaccctttcaggtcactgtggagccccatgttacctcagcgcagagtttggaaactacatcttattctatcataaaaccagtttccaaacacatatgtggttttacatgtgtctattagttaaaatttgtgaattaaattattcaaattttctatctcttcttgtgtttattcattactaagaaaatctcccacaatgattatatctttgatgaatttccccttctaattttgcaaattttgactttatatatatatatatacacacacatatatatatatatatagagagagagatagatagagagagagagagagagagacattctattaggcatatactagtttagagctattatagcttctttgtaaattatttcttttatcaaacattgggtaacaacccctgcatttaaattgaaaacatcctaacatagaccaaaatatctatggcacaagaaccatatttacttattttttattttttagatggagtttttgctcttgttgcccaggctgcagtgcaatggtgcgatctcagctcactgcaacctccacctcccgggttcaagtgattctcctgcctcagcctcctgaatagctgggattacaggcatgcgcctccatacccggctaattttgtatttttagtagagacggggtttctccatgttggtcaggctggtctcgaactcctgacctcaggtgatccgcccacctcagcctccaaaagtggtagggttacagtcgtgagccaccgcgcccgccccatactttactcttaacaaaaatatgtacaagccaaggaaaaataatcactgggcaggtttctaatggtcagattaatcattaaaaccagtaacttaaactgtcccttcagttgatacctagagatttttaccctcctgaaaactgcactacaataaattcagcatccgtaaagggtatacttttcttttgtcaggtgagaaagcagctcaggggttatgggaacttacctaatttcaacacccaaccaatccttaaacacacatatggattaaatggatttcttaaattcctttaaaaatccattattaatctattatccacgtatgcatgtatctacctagcccttttggatcttctgttttttactaggttgaaccacatgaactgctttgtaggtcaaagcagttaactatgggcgatttcttataacccaacttaatatattgtttgagttagtaagttctgtatgttattaaactctatataaagtacttccttttcattcccaaattcctctttccaccttgaaaaactggcttgcaattctatacctaaacttgtggagcaagtttgatgccaattcttttaaatcttatgaaaaggataattacattatttatcagccccctttcaagcttgaaataagtaattaaatctgtttttatccaataataccctcactttaaatcttcatctagtttaggttttagttccttgggttttgttttgttttttaagaaatagtccaaccctggttgcatctaaatgcttttaatgaggtaggaaaatatactcaatgaaaattcccctcaatattaacatttatgaaatgatattactgctgggtgactacatggatattcacccacaagttttataagttatatttatgttttgggcactctgttcagtgtgttatgctttgattaaaacaaattttttaaaataacactactggttcatgaatcatgttaagaactgacaatctaatgcatgtttcttttttccctgcaggatcatttaattcatcttatcaaatagctgcttttttcgatactaacttagactttttttggtaactgaaatttttattgagataattgtatattcacatgcagttataagaatatggagagatcccttgtatgctttgcccaggttaccccaaaggtaacactttgcaaaactatagtacagtatcacaactgggatactgacattgatacaatccacttattttattcagacttctcgttttacatgtatttgcatgtgtgtgtgtgtattacatcccatacaattttatcacctgtatagattcatgttatctaccaccacagtcaagatggtaaacacttccaaaaacacaagatgcattcctccttttataagcaaaatcaactccttctcatctgacaccgtatataacccttggcaactactaacctgtcttccatttctaaaattttatcatttcaaaaattttatataaatgggatcgtatggtatataacctttttatgacagaattataggctcagtataattgtctggagatttatataaattgttgcttgtatcaacaattgttgcttatataattgttcatttttattgccaaatagtatttcatcatatagatatactgtagacatattacagtatgtctatttacccattaaaggccatctgtgttgtttctaagttttggctattaaaaaataaagttgctatatagacatgcatgtacagatttcatatgaatacaaatcttcctttctctgagatcaatgtccaggattgtaagcactgggttatacagaggttgcatgtttagacaaaaaactgacaaactgttttccggagtgactgtaccattttacatttccaccactaacatgagtgatcagtttctccacatcttcgccagcatttggtgttgtcactactgtttattttagctgttctgatagatgtgtagttgtggctttaatctctatttccctaatagctaacgatgctgaacatcttttcatgtgcttatttaatatctgtatgtcctcctttcaatgaaatgactcttcacatctttttaaattagactgttttgttttttcttactattaagtgtgtgtgtctgtgtgtgtgtgtgtgtgtgtgtgtgtgtgtgtgtgtgtgtgtgtgtgtgtaagagccaggggtctcactatgttgcccaggctagagtgcagtgactgtccataggcaacatcatagcatactgcagcctccaactcccgggctcaagagttgtttttgcctcagcctcctgagtagctgggaatacaggtgttatgccactgcacctggctcttactgctgagttctgagagttcattgtatgtgctggatactagtcttttactgaatacgtggtttaacagatattttcttccaatatctaacttgtcttttctatcttttcatatgggctctcacacagcaaaatttttaatttaatcaggtccaatttatcaattgtttcttttatggattaggctttcgtggccaaatatagctctttgtctccagatccagaaaattctctatgttttttcctaaaacttttatagctttgtgctttacatttaattctataatccattttgtatttttgcataaggtgtgaagtttaggctcatcatttttgaaaaagctgtccttccctccattgaattggttttgtaactgctaaaaatcagctggaggtatttgtgcaggtgtatttctgggttatattttctgttccatggtctatgtctttccttctaccaataacacacagtattgattactatggctatatactataagctttcatattgcgtgaagtaatttccccttttttcttgtcaagattgttttagctattctagagactgtgtctttccatacacatttttaaatgtctatctatgtccacaaaatatcttggttgaatttcaataggaaatgcattaaaccaacagatcaatttagggagaatcaatgtcattattacgttgaggcttccaatccaagaacacagtatacatctctccatttacttgtcttgtttcatgtctttcaccagcattttgtaatattcactgtataaatcctgtacatgtttgttaatatatactgaagtattttattttctttgaattgtctaaaaattgtattgtttttaattttggtttctgcatgttcagcatatataaatgcgactgatttctttattctgtgaccttgctaaactcacctgttagttccaggagctttctgatagattccttgggatgttctacatagataatcacattatctgcaaatacggacagttttagttcttcctttacaaactacatacctttcatttctttttcttgccttatatggcactggctagaacttccagcattatactgaataagagcagttatgatggacttcctcaccttgcttctgaatctcaggggaaagcatttagtctttcaccattaagtgtgatgttagctgtgaggtttttgtggtgctctttaccaagatgaggcaattcctttctattccttttatcagaaatgagtaactgatatgatcatatttttcttttttggcttattaatatgggggaatttagagtatttttaaaagatctttcaaacaattaactaaacaagtactggatcttatcaagcaagtggggcacttgggtggattttttctttatgtaggatcttaaacttgcctcacctccaaatctactgaaaataagggcctatggcctgactgaccaatcatcaagaaaagattaggtcaaatttaatataatgtgccaaaagttgaaaatataagtaacaggttttgggctcattctcaacccacgaagcattattcaaccaacacacatgtattttgagaggcattatagcataatggtaagagctctgccatttattagcttgtgactatgcaagttacttaattcctacataactctgtctacaatgtgatgaaaaaaaagaggtacagatgtgtgtttaagtgttgatgcataaaagcctctctaaattgggaagaaagagagcaaggaggtaaaagaaaaaacaattcacacgaaaggagtcagaggccaggtaaacagtacctattaataaacagatgtcatctgtcatcctcaattttgacggatcagtatctgttatttgaagtgtgatccttacactagttaataattctcaaactgtttgttacagttctgctacaagataaggagcttttaccttcagggtgataagcctctaaagtaacaaaaaaaggtggggaggtgagcttgtgccagaatgtaaaccaactgtgaaactaagcacactgtttagttcagctctttatttagacagaaagacctgctttaaacatattatttttaaaaagttgacaaaaattctatatatgtattgagtaaaacatgatgatctgaaatatgtataagctgtggaataatagctatgagttaataaacacagctgagtgcagtggctcatgcctgtaatcccagaactttgggaggctgaggcgggcagattgcttgagctcagaagttcaagaccagcctgggcaacatggcgaaatcccgtatctaccaaaaatacaaaaaattagctgagcaaactggtgagcacctgtggtctcagctacccaggagggtaggagaattgcttgagcctgggaggcagaagttgcagcgagccaagattgtgccactgcactccaacttgggtgacagaatgagaccccatctcagaaaaaaaaaaaaaaattaacacatgcattaccttacatttcatttttgtgtgtgtggtgaaaacacttaaaatctactgtcagtgatttttcaagaatataacacattgttattaactatagttcataaccatgtgatatggtttggctgtattcccacccaaatctcatcttgaattgtaactcccacaattcccgtgtgccgtgggaggtgattaaattatgggggtgggtctttcctgcgctgttctcatgatagtgaatgagtgtcacaagatctgatggctttaaaaacaagtttgcctgcacaagctctcttgtctgctgtcatatgggatgtgcctttcaccttctgccatgattgtgagacctccccagccacatggaagtgtgagtccaataaacctctttcttttgtaaattgcccagtttcaggtatgtctttatcagcaacgtgaaaactgaccaatataccatgttctacagtaaaggtcttgaacttatccctcctatctaactgaaattttttatactttgaatcaatatctccccaaatccctgtaccccccacccctggccccagcccctggtaaccaccatcctacatgagtctagcttttttagactccatgcataagtgagagcatgtgatacttgccttgtttgcctggcttatttctggtaatgtaatgtcctccaagttcatccacgttgttgcaaaagagagggtttctttcttttaaggctaaaaagtattccactatgtatacataccacattttctttttctatttgtctactggtggacatttgggctgattccttatctcgggtattgtgatgcaataaacatgggagtgcaggtatctcttcaacatactggcttcatttttcctttggatatatacacagtagtgggattgcttgatcacatggtagttctatttttaggaacttccccatactgctttctataatgtctatactaatttacattctgaccaagagtgtacaagagtttccttttctccacatcctcaccaacatgcgttatctttcatctttttgataatggttattctaacaggtgtaagatgatatctcacagtagttttaattttatttctctgattagtaatgttgaacaatttttagtatacctattagccagttctatgttttgagaatgtttattctgctcttttgccctttttttttttttttgagatggagtcttgttctgtcacccaggctggagtgcagtggcgtgatctcggctcactgcaaactccgcctcccaggttcacgccattctcctgcctcagcctcccgagtagctgggactacaggcaaatgccaccacgcccagctaattttttgtatttttggtagagatggggtttcacccgtgttacccaggatggtcttgatttcctgaccttgtgatccgcccgcctcggcctcccaaagtgctgggattataggcgtgagccaccgtgcccaatccttgcccattttttaattgttagttttcttgctattgagttcattatatataaccccttatcagatgtatggtttgcaaatattttctataggttctctctttattaatagtctcttttgctgtgcagaaccttttaaatttgatataattgcatctgtctatttttgttttgttggctgtgtttttggggtcatatccaggaaaacattgcccagaccagtatcatggagattttcccctgtgttttcttccagtagttttacagtttcacatcttatgtttgcattttaatctattttgagttgatttttgtatatggtgtgaaataagggcctggtctcattcatctgcatgtagatagccagtttttccaagaccatttattgaaaagactgtcctttcctgtggcatgttcttggcacctttgtcaaaaatcaaccaactacaaatttgtggatttatttctggtgaaataaattcttgcgtgtcagagcatatcttttcaaatattcaccttagttgccttagacacccctttctttttttctgtataacattatttcctttccagttactatggttcgatttctgaaaatacttgtagtaggaccaaaaatgaaattaactaaagaaatctcaagtaatttcttatttcaaatttaagcattccccaagtaagccgtagaaagcaaacttttctgttccactgttctgtgtgtgtgtttttatgtctctatcatgctgttttgattattatggctttgcagtagattttcatatcaggtagtgtgatgcttctgggttcattcttttaagattgctttggctatttggggtcttctgtggtttcatataaattttagtttttttttttctatttctgtgaaaaatgacattagaggtttgatagagattgcactgaatctgtacatcactttgggtagtactgatattttaataatactaattcttccaaatccgtgaacatgggatatctttcaatttacttctgtcagaaagactctcttgaaggaagcagtgccttcttttacattttggcacaagctccctaacttgtcacagatcaggacttttgagtagcacggcctatatctgaagtatttgtcttaaaacttcaatacatgacttaaatataagtgcatatttttagagatcataattaaatttaattcgtgaatatcagcacttaatcgactacatagccacaatgtgattaggcattttgagatgggctaagaaagagacttaggagttatttgggaggctggggtggagggatgtagatggatagtgaatgtggttattatctgcactttagaagcttacaatctaagggaaaatgaaatattcaaagcaaaatcccatggagtaaagtgagttacaattgacagatgatatccactagtttaatttctcagtgaaactctggggactagctctcttttgttttcaagaatctcaatgtcactaaataaaaacaatgtgattctctcctcaatggagcaatagagagagcaaggcctggaatcagggacagatactctgaccataaagagtggaagaatcttctcttgaagagctctccacatctctgtaaaatcacatcaaaatcaattaagttttgtctgaataaacttcaggcgttgtttcaggaaaagtttgctttctactgcttacttggggaattcttaaacttgaaataagaaattgcttgagatttctttagttaatttcatttttggtcctactacaagtattttcagaaattgaaccttagtaactggaaaggaaataatgttagccaaaaaaaaaaaaaagaaaggggtctctaaggcaactaaggtgaatatttaaaaagatatgctgtgacatgcaagaatttttagttctataaattagagaaggcagcacaacaacaggaggaggatcaagtaaccaaatataatatataaattagtagcttagatttataagcacattagaagggctaaaatgattaaacaagaggaggcttctgaactaatacaaaagttttaaagttgaattgcaagcgtgaaaagttaaggaaaagtaagggcccatatctggtggcagatggtgtaatgttaacagatggcaataattactaattacttaattccaattttacttctattgcatctattaaagaaagtaatcttcatttggtgaatgaaaatccagacaaaaaaggacgcacactattctacctatatagagttctaaatatgcaaaataatctgttagaaatcagaataatggttacctttggggataaccaatacctagaaagaggccctggggtattctcttttttgatccaggagctggtggttacacaaatgtgttcacattacaaatattcatcaagctggatacttacgacgtgtggactttttgtatgtatggtgtatgtcaacaaaatgtgaaaaagaaaaaaagtttaaagtgttaagactggaaaaaacaccttactttattaagctaaggcttagctcatttctctggtctaaatgacccaaagatctgaaagaacttgcaaatatgattaccaaagtattgttgtgtccataaaggagttgacagggaatgggaattagcaagtatttttatgcttatgttaatgtttattatgctaatgtttattaatatacaaaatgattgatgattaatagataatagacaaaataattctatcattagttgttaatccattgatgattgaaacaaaaaaatgatcttccttgttaatttcctaattttggagctactggactaattacatagaaaatattctatgttgtgagtagctggaactacaggtgcgtgccaccacacccaactaatttttgtatttttagtagagacagggattcaccatgttggccaggatggtctcgaactcttgacctcaggtgaattttttgaaatttagtaaatatatactacaactcttagcaagtattttcaaaatttacttttaaaaagggggcggggaaagggtacaggagaatggatgtcaggaactatatactataccaatgagcatgacactgatttgcaaaaattcaaaatatggttatttaaacacttagaaaaaataagctaatttcaatttatccttcaggtttcagcttaaatgttatttcttcagacaagtcacctttgaatgcccaattttaaaaaaaacctcactctgttaactttcatggctatttttcctccatagcatcatccacaatttgtaaggatatatttggttatgtgattatttatctagtgttcacctccatgagacaattgctcaaatggtaatgcttggttgaataactaaatgcatttctgatgaagaccttatgaatgtagttaaaatgagcttctggcaatattgttgtaaaactacagatttgaagagctacctagcccgtgtatgaaacaaagtgtgtatttaaaataattcttaaataataaatgcacaagtctatttctagtgactctaagaaaatgtgtactttcagaatcaagacctccttccttctccctacaactgaaaagtttcaagacggtaatttttttttttttttgagacagagtctcgctctgtcacctaggctggagtgtagtggcgtgaccctggctcactgcagcccctgcctccagggttcaagcaattctccagcctcagcctcccgagtagctggaactacaggtgtgtgccaccacacccaactaatttttgtatttttagtagacagggtttcaccatgttggccaggctggtctcgaactcttgacctcaggtgatctgtccaccttggcctcccaaagtgctggaatgacggcatgagccaccgcacccagcccaagatggtaattcaatataggaaggagttttaggagtgaattacatgaggaaaagtctaacctaagacaaacaccaaagatctgaaataagttttaaatttattttttaaaagatatatgtataggccgggcacggtggctcacgcctgtaatcccagcactttgggaggctgaggcgggcagatcacgaggtcaggagatcgagaccatcctggctaacacggtgaaaccccatctctactaaaaatacaaaaaattaaccggacgaggtggtgcatgcctgtagtcccagctacttgggaggctgaggcagaagaatggcatgaacccgggaggcggaggttgcagtgagtcgagatcacagtactgcactccagcttgggcgacagagcgagactctgcatcagaaaaaaaaaaaaaaaaaaaagaaacgtgtaaagaaagagaattcactattattttctggattagcaatttaaatatttgtttcaaataaaatgtgttcacatgaaaacacaatttgggccaggcatggcagctcacgcccgtaatcccaacagaaggacgattgtttgagtccaggaattcaaggccagcctgggcaacatagtgagacctagtctctacaaaaaataaacaaaaattagctgggtgtggtggtgtgcctgtattcacagctgggtgtggtggtgtgcctgcattcatagctactcagccagctgaggtgggaggatcacttgagcccgggaggtcaaggctgcagtgagccaagatcacaccacttcactccaacctggacagagtgaaacgctgtctcaaaaaaagaaagagaaaaaagaaaacacaatctgatgaaggtaactctaaaatcctccaaaaataatggaagaaaatacaataaattttaatagcagttgctttcagttgggaaaacacaaggtttttctacttttctacttttatttacttctgtaaagtatctttaacaaggatgtgtaacttttacataagcaaagggagaggaagcccacagaaagaggatgtcaaagaaaatgtatctaacttcatcagatgttatgagaatttcagtgatggtaaagtgcttcacacagggcctagtaccctcagtaaatgaaagctattatgaataagtaccatgataaagtatccagtgatgtgtggttttagggatgaccactaatttgccacagtattttcattattcaagatacacagaattttaacatcagaaaaatctaattacttttctttaaatgtaaatcaaccttaccttccgcagttccactgtcacttcatttctatgtcttcgcattgtctagaaaagaaaaacaaagattacagatgtatcaaaatacggacactgctagtatataaagatctcagctgggtgcagtggctcatgcctataatcctagcactttgggaggccgaggcgggcagatcacttgaggtcaggagttcaaaaccagcttggccaacatggcgaaacctagtctctactaaaaatacaaaaaaaattagccgggcttggtggcaggcacctgtaatctcagctacatgggagactgaggcaggagaactgcttgaacccgggaggcggggggatgcagcaagccgaggtggcgccagtgcactccaggcctgggcgacagagcgagactgcatctcaaaaaaaagaagaagaagaaaaaaaaaaactcaggtatttgagttagaagtcatttaatattggctgggtgcagtggctcacacctgtaatcccagcactttagaaggctggaggatcacttggggccaggagttcgagatcagcctggccaacatggcaaaaccccatctctactaaaaataccaaaattagctgggtgcagtagcacgcccctgtactcccagctactcctggaggctgacgctcaagaatcgcttgaacctgggagacggaggttgaagtgagctgagatcatgccactgcactttagcttgagtgacagagcgagactctgtctcaaaaaataaataaataagaagaaatttataatctcaatgactgatacatcttatactttaaatgatgagctacaattagttaaaaagccaaattctgtatttactggatatctgttggttaattttgtggaaggtgggacttggctgcctaggacccatttccctgccctaactgtacccagtcatctttggggaattacatccttcccatcctgtagtcttaatgagacctaaagtggctcactctctcctagcttaagtaggtcacaagactcaactacactatcagaattatctcctctataactctgaatcttaaggagaaagggaaaaaaaggcacattaaattccaaaggaagaattttggacaaggtagtaaataatgcctatatccttgacttgctcaattcccagttcttccatttctctactcatcttatgaactaccttacattcttccaataaattatggttttgcttaagtcagccagggatggtttctgatgtctgcaatcaatgaattatatctctaatgattcatatttttaaaaagtaaattcattgccatggccttaaaaacatgaaaataaaaataagtttgagatagatgttttgtatcaaaaggtaaggtatccttctgagtttaagaggatctatcaggcatgccttatggggaaacactgaaataatatatatctcccctctaacatactgatataatggattcttttattacacatataagcatggttacatctttatattattggaataaaggctatatgatcatggtatattattattttaatatactgccaaggttcagtgtgctatattttatttaataattcttgtgatatctctttcttaaaccacagtgatcttcttaagaaaaaaaatctcataaaatccaaattataaagtttgctaactatactgaaataatctagatataaacttaaacttaaatacagatatatattaaatagaaacaaaactgccaaacaaaattcaaattagtcatattcatttcatgtgatggaattatatactgataaaaactattatccctgataaggttcgacactagaaagaaccttgaatttaattctatatttagtatgtttctatattgtgactttagtactattaatacagagaatgtcttacgcataagttcataaaaatgacaaatgttgaacaatcttcaaataccaacattaatgaagtgttatttgacaactctataagctatctttattcactggaagattagaactctaccactgttaaaaattttacctaaatgaatatttacttcaatttttcctataactgaaaagaaaaatattttcattgcaatatttgcaacacttaactatttatgaattattaaaagatgatgcataacaaaaagatccaggcagcatatctgctccaaaatatgattttctgctctatcatcttaattcacactaagatatttctgtatagacagaattagtgagttaaattctgaagaaccacactaaattaggaaaccacacttaagaggtgattaatttaatgttttaaacacccctaaacaggagttagctcccaggtagtaagtgcttcgaatatgaacatctcaatttatagacactggtttgatactctgcataaggaaagttggaaatagatttttactgctaaagtagaacagttattcaagatatacgaattgactagaaatacaggcacctcgattcttacttgtttggggtctaagaatccggcaggccctacagcacaacttcagagaagtttctgtgtctagaaacccccttgatcctgtgttccatcccttcttagagaactgtatcacctaatcctagtcagaacattgtggtatctgcttagggttgaagttttcttacaaggtggtaatctccagtctaaaagtactatacccatgaaacgaaccatatgacttttgtgactgcttactaatacatatttatatatgcagcataattctaagatttgtgtatataactcactagtagcaaaacttcaaaggcgaaagtatctgttaccctcacctatctctaataattaaagaccacttattcacccgaaagaatcatataaatgtaaatggccaaactcacttaggtcagttaagaagaggaggtactgactaccatacctaagtacctctgagttagtcatgacttactatgctctttgtttaaattacagaaaaagatggactcccttatattctcccttatattcttcccaagtgatctcatctaccctcatgtctgcaattactgcttcatgaccactcccaagtatctatttttagtccactctgtctcttaagctcctaatctataagtcattcacccattcaacaaaaatttactcaatacatttaaaatacattgggcaatacatttgccaaccgggaagcaagtacagaattcacagtctagcacagggatcggcaaactataacctgtgtatcaaatctggcaggctatctgtttctgtaggtcccaacaggaatggtttttacattttttaagtggttacattataaatgatattaagtacctacatcatgctcttatttttgcctctttgccctcaaatgctaaaatatttactatttgtccttttaaggaaaagttagcagactaggtgcagtggctcacgcctgtaatcccaacactttcggaggtcgaggcgggaggatcacttgagcacagccatgctcagctgatttttcattttttgtagaggtagtatctcattgtgctcatgtgtgcacctacagttccagctacttgggggagctgagatggaggattgcttaagcacaggaagtcaagggtgcaaggagccatgatggtgccactgcatttcagcctaggtaacagagtgaaaccctgccttggaaaaaaaaaaaaggtttgccagcacctggtctagtggaaatgagagtaataatgagtgataaaaatgtgttaagctggccgggcacagtggctcatgcctgtaatcccagaactttgggaggccaaggcaggcagatcacctgaggtcaggagttcaagaccagcctggccaacatggtgaaaccccatctctactaaaaatatcaaaattagctgggcatggtggcgcacgcctgtaatcccagctactcagtaggctgaggcacaagaattgcttgaacctgggaggcggaggttgccatgagccacgagtgggccactgcattccagcctgggcaacagagtgagattctgtctcgaaaaaaaaaagtgttaagcttgagataggaaagtaaatgttaagatctgtatcaagaggagatataatcagagggacagaaaaaagctcccaaaagaattaaaatatgtgcatatgtgtgttaagggctggaagagagatggtttaaaggcttcaaactcagtatgcttaaaactaatatacttgttcccttcctaacaccctcaccaaaaagatcccccacatctcctctcctgtcaatactcctaatgttaggaaactgtacaaccatccaaatagtttcaagagaccaatcctggaagactatccctgtctactcactttcaatcctctgaaatcaaacaagtcaaccagaacaggattcaaacctcccagctccacggccactatctaagagtaagccaccatcatctaatctggactactaaaatagcctaactagtctccttccatgcactgaatcaattttccacaatgcagccgggggggttctttttaaaatgcaaaatctgtgtcatctttctcttgaataaaatgtgtcaatgatttttttcatctcttggcatcccctgccccacacaaaaaatgtcatcagaatagccaaacttaaactccacagacaaaacctacaagagggccaggcacagtggctcatgcttgtaatcccagaactttgggaggccgaggcgggaggattgcttgagcccagaaatttgagaccagcctgtgcaacacagtgagacctgtctctacaaaaaaattaaaaattagccaggtgtggtggcgtgcacctgtggtcccagctcttcaggaggctgaggcaggaagatggcttcagcccaggaggtcaaggctgcagtgagccatgatcataccactacactccagcctgggtgatagagaccctgtccccaaaacaagcaaacaaacgacacctacaaggttgggagacaaagtattctaacgaattctcaaatacaagcagggtctggttaaatcaccagctacaggattcatatgcatatatgcagaagaaaatggaagggcagaagttatggggcgattgaagaccctgagaacaagagaactcccaaatcatgaatgactagagactttggaaaggcaacttgagaacagttgcaaatggaagggatcttttgcacacatcaacattgttaagtatgatggagctagacacaaaatcaaagaactaaaatcctcttcctggacaatgtcctacaatgaacagagccagacctcagaaaataggatgccaatgccacccccttaaaaaaaaaatcatcttgtaacaaacaacagaagaaaaagatcttgagtggtgaaactagaaaggctactctgacccacttcttgctcttaaaagttcaggaaaatctatcaaaaaatggacaggaaaggattggcgttgaagcccatgctgtaagaaatgagagaataggaaacagagtgttgctattgaaagcctactgaaaagacatatacacaaaagtgataaaaactatcctagaaaatgatagaaaatgtgaaataacattatcaatcagaattagaaaaactcagaaatgaggtcctagcaatcaaaaaagaattagaaataaagcaaaaaattatttcagaaaggaacctagccaagagcaatcttaagagccagtaaacaacagataatgcttaagagaaacagaatatgtaaagaaaaaaactgtaatcagaaatgaaggtgaaaattatcagaagggctgggcacggtggcttacgtctgtaatcccagcactttgggaggccgaggcgggcggatcatgaggtcaggagatcgagaccatcctggctaacacagtgaaaccccatctctactaaaaatacaaaaattagccgggcatggtggcgggcgcctgtagtcccagctactcgggaggctgaggcaggagaatggcatgaacccgggaggtggagcttgcggtgagccgagattgcgccattgcactccagcctgggtgacagagcgagactctgtctcaaaaaaaaaaaaaaaaaaaaaaaaaaagaaaattatcagaaggaagtgacaataaaggcacttagattttaaattcatataataaagactcctcaaataagaaaaccgaagcaatgaaatagagcaaatacttaaaactataaatcaaaaaaaacttcctgaaattagaagacttgaactgaaatactgaaagtacacccaagtacctggggaatccatccagaaaaaccaacactgagaaatatacaagtgaaactaacggacttccaaaaagaaaagaagagaaaattgcatctggacattaggcaaaaaatattgaaaatgtgaatcaaggactttatatccagtcagaaccactaaatttaaagtatacaagtggcaaaacaactgttataaacacaactcaaggactactgtttatatgagcactttctgaagaatctaatagagaatggtcaccacacaaccaaaataactggagagacactgataaaaggtgaccgtgagcaatgaatttatttacctgtagaactaagattaaatagtccttataaggtaggcccaatccctgggccgtgaactggtgccagtccatatagcctgttaggagccaggctgcacagcagcaggaggtgagcattatggcctcagctccatttcctgtcagatcacggttggcattagattctcatagaaacacaaaccttgttgtgaactgagcacgtgagggatctaggttgtgtgctccttatgagaatctaactaatgcctgatgatctgtggtgcaacagtttcaacccgaaaccatcctccccgacccgccattcatggaaaaactgtcttccacaaaactggcccctggtgccataaaggttggggaccactgttataagggaaaaaatacagtatttaactgctacatgccctgacaatgtagacacaaaattgaaaggaagacaaaacatgcatatgaaatactgagtaagtgggccaggtgcagtggctctcgcctgtaatcccagcaatttgggaaactgaggcgggtggagcatttgaggccaggagttcaagaccagcttggccaacagggtgaagcctcatctctactaaaaatacaaaaaatagccgggtgtggtggttgcacctgtaatccaatcccagctattcccggaggctgaggcagagaattgcttgaacctgggaggtggaggctgcaatgaactgagatcacgtcactgcactccagcctgggtgacagaacaagactccatctcaagaagaataaaaacaaaaaaacaactaagtgtattgattgccttattaactattaactggtgagaaaaggaaattgcatcacatcagatgctgaagtagagcagaaaagaggttaaagcagtgctgagagagaaatttaaagcacctaatgcaaacattaagaaagagagaaagtctcaaaccaataatcaaaactcccagcttcgacaccctacaacataaaaagcaaaacaaacccaaaacaagcagaaggaataaacagaaatcaatgaaattgaaaacaaaaagtagagaaaattaatgaaaagctagttctttcaaaaaaaaaaaaaaatcagcagactggccaaaaaaaaagagaaaatgcagagttataatattagaaatgaaaaaggtactatcactacagactttgcagacatcaaaagaacaagggaaaactacaaacaactctacacacacaaatttgacaatttagatgaaatggaccaatgactcaaaaagcaagaactatcacacctcactcaatatgaaatacctaatttgaataacgctgttaactattaagatgattatatttgtaattttaaaacttcccttcagggtttggatggtttaactagagaattcttccaaatgcctaaagaagaactaacaccaattttatataatctctacaaaaaacagatgggtacacttctcaattcactttatgaagctaattacaaaattacctgaataacaaaaccagaaaagacagcattaaaaaaaaaagaagaaaaagaaactgcaggccaatattctcaatgactgcagatacaaaaatccttatcaaaatgttaccaactagaagtcactatactagcaggcttcattctagtgatacaaggctggttctgtatttgaaaatcaatcaatataaaccatactaatagactaatgaagacaaatcaatgattatattattcaatgcagaaaaaaatgacaaaattcaacatccatttatagtaaaaacactcagaaaaataaaagcctagagttaacattctagtggtgaaaagtctgaatactatgtttccctagattgagaacaagaaaatggtgtccactctcaccactattattcaacatagtataagaagttccagccagtaaaataaggcaagaaaataaagtaaaaggcatatagatgcaaaagaaagaaaataatcccagccaggtgctgtggctcactcctgtaatcccagcactttgggagactgaggagggcggatcacgaggtcaagagatcaagaccatctggtcaacatagtgaaaccccatctcaactaaaaacacaattagctgggcgtggtggtgcacacctgtagtcccagctactcgggaggctgaggcagaggaatcgcttgaacccaggaggcggaggttgcagtgagccgagatcgtgccactgcactccagcctggcgacagagggagactccatctcaaaataaaaaataaaataaagaaaacaatcaattatttgcagaaaagatgatttaaaaattccaaggaatataccaaaaactttccagatctattaagtgagttcaacaatgtcacagaatacaacataaaaatcaattatatttctatatactagcaatgaacacatagacactgaaattaaaaatacaaacaacagccgggtgtggtggctcacatctgtaatcccagcacttcgggaggccgaggcaggtggattgcttgagccaaggaatttgagattagcctgggcaaaatggcaaaacctcatctctacaaaaaaaagcaaaaaaaaatttagctgggcatcgtggtatatgcctgtagtctcagctactggggagggtgaggtagcaggatctcttgagctcgggagacggaggctgcagtaagtggagactgtgccactgcactccagccacagcgacagagatagaccctgcctcaaaacaaacaaacaatgctggatgatggctcaagtaatcccagtgctttgggaggccaaggagggaggactgcttgagcccaggaggtcaagaccatacatagcgagactcagcttctacagaaaatttaaaaattagccaggtatggaggcaagtgtttattgtcctagttacttgggaggctgaggcaggaggaccgcttgtgtccaggagttcaaggctgcagtgaactatgattacaccactgcactccagcctcagtgacagagcaagatcctgtttctagcttaaaaaagagaaaaaatggaggggcatattgtgttcatagattggtagactcaacttggtaaagatgttgattctcctcatactgatatacaggtttaatgcaattcctatcaaaatcccagcaatatattttgcagatacagaattattctaaaatttatacggaaaggcaaagtaagtagaatagttaaaacaattctgaaaatgaaaaacgaagtggaaggaatcaatctagccaatttcaagatatattacatagttacagtaataaacattgtgtgatatcagtggaagaatatacacattgaaaagaacagagaacccaatataagcctacacaaatatatccaactgattttttacaaaggtgcaaaagcaattaaatggaggacatcaatagacttttcagcaaacagtgctggaccagatagatattgacagacaaaaatattaaccctgacttaagcctcacaccttaaaaaaaatttaattcaaaataaatgtgaaactataaacttttaggaaaaaccacaggagataattctttgggatctggggctaggcaaagagttcttaaacttgaccgtaaaaagcatgatccataacagaaatagttggtaaactagacctcatcaaaataaaaaactattttgctctttgaacacccatgtaaagaagataaaaagagaagctagagactaaaaaaaaaaaatttgcaaccacatatccaagaaaggactagtatctagaattaaaaaacaaaaacaaaaaacctctcaaagctcaacaggtaaccaaccaaccaatggaactagaaaatgggcaaaagaaatgaaaaaatatttcatggaagaggatatacacatggcaaataagcacatgaaaagatgttcaatactattagccattagggaaatgcaaattaaaaccaccatgaaatcttattatacatctaaaatttaaaattgtgatactttcaaatgctggtgagtatggagagttttcatacattgcttgtgggaatgtaaaatgacagcacctttggccatttcttaaagtacacatgtaacaaccacaggacccagcaactacacattggacatttatatgagataaatgaaaactcatctacacacacacacacacacacaacctgtacgcaaatgtttacaacagctttattcttaatagctacaacctggaaacaacccaggtatccttcacgcttaaactgtggtacatccataccatggaacaccatatagcaattaaaagaaacaaactgctgatacaaacaatgacttggatgaacataaatactgtacgagcatcttgcaagatgttaccactggggaaactggagaaaggataaacaggatctctgtgttatattttacaactgcatgtcaatctacaatcacctcaaaataaaggtcagtttttaataaaaattttaaaggatatacatcagatgctgagggggaaggaaaagagaaggtcacaactaatttcaataatgtacatgatggggaatcaatagaaaataactaagaaagagaggactaaagaaaacaaaaacaaaaccacaaactagaggccaaaagtatactaaaacaaaaaataaaacagatcacatacaatgattattttacacataaatatataggtgatgacaaggaaactaggacttgactttaaaaccatgaaaataaactgcgtatgaatatgacaaaatcaaatttaacaagaaaagcaatccctaaaaataaagaaatgaacctaaacgtgtatccatttggtagcataatcacactatcctgtgtaacttttcaacacagcaatttaaccctgcatctccagttaaccctaaagagaactaccaggaaaactccaaactgttctcggtaaccctattactgggtgcagcgctgctggtgttgttattctgagactgttatgtgtctatgtggaataaagcaaatgagtaaaaatgtcatattctattattcctggtgtcagaaaaaaacaggaagtttggcctaggagaaagacggatatatgatagaagttgtttagtaaaatcccatagtcctgaatttgaattggaatatcaatatatgcattatatgtgtgtgtttatgtgtgtatgtatgtatataaatatgcatataaatatgtatacatataaatatacacacacacatatgtttatatacatacacacacacacaaaattttgttttaatcctatatctatccaccccaagatgtctacttggagatgtgtatctccaacgcctagaaacagtgaccaaatcagtgagtgcatagacaatactctcaaaaataccaccaatagcaaacagaactggttcattccaactaatgggcagaaaaggtacaaggtaagcctgcaatatcttaacataccaaatatcaaagatatttacgagactagagtcttgtaaaaactactcaagagctaacatgaagaggctccaaatgttcaaagacaatacaattattatcaattatcaataagacaatgaattcaaacacacatagatttcaatctgtaaatccaggaaatggaaataaaaacccaaacaactaaattgtcatcactgaaggatgataatgaactacctcattattttgaaaactgataaaggaaaagaatcaagcatttattttactgtttctaaacaaattttatcatggggtaatctaaccaattaataaatgagaggaaggtttctcttaatagatgtagtctagctcagctgttcccaaactttttggcaccagggactagtttcacagaagacaatttttccatggactaggaagtagaaggagtggtttcaggatgattcaagtgcatgacatttattgtgcactttatttccattattattatattgtaatatgaaataattacacaactcaccataatgtagaatcaatgggaggcctgagcttgttttcctgcaactagaggtcccatctggggatgatgggagatggtgacagatcatcaggcattagattctcataaggaacatgcacctagatcactcgcatgcacagttcacagcagggtttgtgctcctttgagaatcaaatgcagctgctgatctgacaggaagtggagctcgggtggtaatacaagcaatgaggagcagctgtaaatacagatgaagcttcacttgcttgcctgctgcctacctcctactgtgcagcccagttcctaatgggccacggactggtagtggtccagggttggggatccctggtctagcttaaagaaggagtgatagattatcaccattttacaaatcctagtaaataacagacttagacaatgttcctcagtggtgatgtcaacataacagaaagagacagccagacactacgtgcctttctgatggaagagaaaaccatcacatatgatgcagtcatgttcccaattcccccaaatcatctgaatctgataaagcctccagcttcaactttgaatttacaggaaatacagagggccaatacacatgtcaagtgacatgataagatgtaaaatccagccgggcacggtggctcatgcctgtaaacccagcaatccaagaagactgcttgagctcaggagttcaagaccagcctgggcaacatgatgaaatcccatctctaccaaaaatacaaaaaacaactcagccaggaatggtggtacatgcctgtgattccaactacccaggagactgaggtgggaggactgcttgagcccaggaggcagaggttgcagtgagccaagatcacaccactgcactccagcctgggtgacagagtgagatcccatctcaaaaaaaaaaaaaaaaaagcaaaattcagattatgagaacctccatgaacccagtttctccaacaataaagtgcataaaaaagacaaagatggtgagattaagagaccataaattaaaaaggagactttgagttcacatcaatcaatcaatcgcaatgtgtggaccttgtaatagttgattccaggtgtcaacctgactggattaagggatacccagatagctggtgaaagcattaattatcctcagtggttcagacagcactgagctcgtccctcttctgctgaaaggaaaacccgggcggtcaggcatttgattagaatgactgggctgtcccagtgcctgtgagggtatttcctgaagagactggcatttgagttagtagactgataggggaagtttcactctcaatgtgggtgggcagcattcaataagctggggcccagatggaacaaaaagaggaggcaagagtaattcttgctgtcagaactccagattctatggtcttcggattccaggacttgcaccagcactgctgccctttccccccatgatcacgttggcaagtgtgataatggtatcgtgtttttaaaaagaattcctatattttaaataacatacatattcttaataacaaaaaagtaggacaaaaacagtatatgttacttctgaaagacgtcatactttgggaggtcacctgttctacaacaactggatcctggctattaacagaaaaaaatattttttaatgcagtgctgatgtcatataagtagtagagaagagggtccctctccctctccctctccccacggtctccctctccctctccccacagtctccctctccctctccccacggtctccctctaatggcgagccgaagctggactgtactgctgccatctcggctcactgcaacctccctgcctgattctcccgcctcagcctgccgagtgcctgcgattgcaggcgcacaccgccacgcctgactggttttcgtatttttttggtggagacggggtttcgctgtgttggccgggctggtctccagctcctaaccgcgagtgatctgccagcctcggcctcccgaggtgccaggattgcagacggagtctcgttcactcagtgctcaatgttgcccaggctggagtgcagtggcatgatctcggctagctacaacctccacctcccagccgcctgccttggcctcccaaagtgccgagattgcagcctctgcccagccgccaccccgtctgggaagtgaggagcgtctctgcctggccgcccatcgtctgggatgtgaggagcccctctgcccggctgcccagtctgggaagtgaggagcgcctcttcccggctgccatcccgtctaggaagcgaggagcatctctgcccggccgcccatcgtctgagatgtggggagcgcctctgcccagacgccccgtctgggatgtgaggagcgcctctgcccagccacgactccgtctgtgaggtgaggagcgtctctgcccagccaccccgtctgagaagtgaggagcccctccacccggcagccgccccatctgagaagtgaggagcccctccgcccagcagccgccccgtctgtgaagtgaggagcccctccgcccggcagccgccccgtctgggaagtcaggagcatctccgcccggcagacgccccatccgggagggaggtggggggcagcccccgcccggccagcctccccgtccgggagggaggtggggggcagcccccgcccggccagccgcctcgtccgggagggaggtggagggcagcccccgcccggccagccgccccgtcgcggagggaggagggggggcgcctccgcccggccatcgccccgtccgggaggtggggggtgcctctgcccagccgcccctgctgggaagtgaggagcccctctgcccggccaccactccgtctgggaagtgtacccaacagctcatcgagaacgggccatgatgatgatggcggttttgtggaatagaaaagggggaaatgtggggaaaagatagagaaatcagattgttgctgtgtctgtgtagaaagaagtagacataggagactccatttttgttctgtactaagaaagattcttctgccttgggatgctgttgatctatgaccttgcccccaaccctgtgctctctgaaacatgtgctgtgtccactcagggttaaatggattaagggcggtgcaagatgtgctttgttaaacagatgcttgaaggctgcatgctcgttaagagtcatcaccactccctaatctcaagtacccagggacacaaacactgcggtaggccgcagggtcctctgcctaggaaaaccagagacctttgttcacttgtttatctgctgaccttccctccactattgtcctatgaccctgccaaatccccctctgcgagaaacacccaagaatgatcaataaaaaaaataaaattaaattaaaaaaataaataaataaagtttacaccaaggctggcttaaaaaacaaaaaaagaagaggagaggtcggtcaagttgaacctaagagggaagtcataaaaagtaattaagtgaaatgaaaactatgaaggtagctgcctatttcatactgggaacaaattaagtcctgacccctgatgccaggttggagagttaaacctaaattaacacttaggttatacaacataaaataactacagcaaatatttcaggaacagaaaaatggaagtaaaatatatcagcaagccagaagaaatgatcagaaatgaccagatctgaaaaatgaaaagaaccaaacagaactctgagatatgaaaaaataattattaagttagacacataaccaaaattaagaactgaacagatgggttttacagcaaatttaaagtagtttaagagattctgtgaactttaagacaggtcagaagaaaccgtcaattatgaaataaaagagggccaaagatgacaaatatagaaaagagggtaagaaacataaaggatacaataaaaaatacaaaacagtgtttgtttgggttcctctggacagaagcaactgttaggagataatagctaagaattttccagaattgataaaaaacaataaaccacagattcaagacacccaacaaactccaagtgggaaaataaaaagatttcttttcccaggaggaaaatatcctagaaggagccagagaaaaacagattatcttcaaaaagcaacagactaaaaactggccaggtgcagtgcctcacacctgtaatcccagcactttggaggcctaggtgggcagatcatctgaggtcaggagttcaagaccagcctggccaacttggtgaaaccccatctactaaaactacaaaaattagctgggtgaggtggtgggcaccagcaatcccagcactttgggaggctgaggtgggaggagtgtttcagcccaggagttcaagaacaggctgggcaacataatgagacatctctacaaaaagatttttaaaaattagctgggtgtggtgctgtgcacctggagtctcagctattcgggagactgagatggaaggatcgcctgagcccaagaggttgaggctgtggtgagctgtgattgtcccactgcactccagcctgggtaacagagagagaccctgtctcaaaaaaaaaaaaaaaaaaaaagagtcagtttgtcagtttttagtctgttgggtttgttttgttttgttttgttttgtttttttgagacagaatctcgctctgtttttgtttccttcttatatagtcctcatacttcatcaactctaactcttgtacttctatcctgttgccctggtgaaaagttaactctgggttgtttcaattctcactccaaaagctgagttgctaagtgtgcaacagaaaaaataaattactcaacctccattataggtataacaaattctaggtctctaacctcaattaagctctcaatgcttactgtctggaaatctttccaggctttcctagttagattttgcacaaaaagctactgctcaagcccccttccaaatcgtccttcctctcagcagaagaccaggcctcatatttattgagaaaacagaaactatcagatagtagcaactccctcaacttcctaacgtgcacgtccaaatctcctccccaatcccaagatccctgtctcctttcatcctatcacaatgacagtgcaagaggtggctagctgtgcactgaatctaattattctctcatcaactgtccccttgcttcatcaattatccatctcctctctcccatctttcaagtattctatttcccatatcatgagcatgaccatgtctttcacttaaaaaaaaaaaaaagaacctttctcaatctacattttcttttaactagttcctgttctcttttgccaaaatttttgaaaaagtagtctagactgtcttcacttctacttatttagtccactccatccaaaattccattggctctgctcttgccaacattatcagcaaccttctattcatggaacacaatccttaattacatggtacctttgcgggagaacacttcattcattctcatctccttgacttccataacaccacattcctggttttcctcctctttggtcttcctccttcatccatccatgttgctcttcccaaggttttgcctattcatctagttactctacaaaccctttctaggttatcatatatatctccatggcttcaattatcaattaagtattaataactctggataatccagatttgtttcctgatgaattctgaattgggcagtaatatgtaacttttcaatgttataaatagaatacatgtaagggaaaatctagttaatctttaaatacagaaaaatatttgtatctggcatctaaaacgtactatttattattttgctcacctgtatatattctaggttatgattaatcaatacagcaatgtggaaccattaccttttttgtcataacagctttgagatataattcacttaccaacaattcacctaaagtatacatacaattcaatggtttttagtgtatttcactgagttataaaactattaacacaatcaattttatcatattttctgagaggaggtctcactatattgcccaagctggtctcaaactcctgggctcaagtgatcctcccatctatgcctcccaaagtgctgggttacaggcatgagccaccgcgcctggcctatattttcatcactacataaagaaaccttttatcctttagcagacacttaccattctaccaagctccccatctcagtcttacaaaaccatttatctactttttgtctctatagatttgaaaatgctgacataaaatgtcagatgtcagacgtcaatcacccctccaattatagctccctttagctagcatcctttaagtaaactgctgtatttctaagtaaacagattttggtgtgttctgcaagtcccataaccttgggaatttaagcagcttaaaattttaagcccggatctctctcctgaactaaagtatctcctggatcactccctagaaaaccccacatgttccttaagacattcaaaactgagttcatcattttcctcactggtcttacttaatttactgttttcaccttatctgtagataacagcactctctaaaagtgggatattcaactacctcaaaaagtagttccaagaattaaataaaataaacattaataaaagcagctcgtgtcacgaagcaggcagtcatcaatgtttgtttcccttttctgtctacaggttgtaatctccatttccaatattaaatgccattacttttcctgtccattgaggttttaacatcaatgatttatttttcatttctagcaagtttatttttgtagtacttcttaatgtttttaggtccttcttaaaatgattcaatcatcttaaaaatatttattttacagtctttctctgattacctctattgctgaatttcttaggagacataagactgacgtttttggtgtctgtattatctgtgatatatttcttcctgtgttttataattttggattatgaacctgttctcttcctgtgctagtgagaccatccaaaatttgaaacatttagcctctctataagagtaactaaaaatcaaataacttagaatctaaatagcagaaattatattaaatttgctatttgaatggcatcctctctggaagacaagcattattttgatctaaaaagtcttttctagtatgtgaaattaagaataaatcggaaacttcaaacttccttctctatccagttccactggtctgccagttacagattaaaaaaatatagcagggggtggagaagtttattaataaacctaacatcaaaaattaaagcttgttttacccttccaaaaaagcctattcctactccactgcagacagaaaattccactgcgttaatattacaagatatcaactagaatttttttaaaaaattaagaagggagtgagatttttcactttacaaataactgaaatgggattcctttttttttttttttcctcttcacagaggtaatcaagttaggatttttttttttttttttataattttaagttctgactgaaagtataggtttaggactaaacacaggacattatgtcctaagagtttaaaattttagagcaataccatgaaataatttaatacaagaataatatcaattaggcctgtgcagtggctcacgcctgtaatcccagcattttgggaggccgaggtgggcggatcacttgaggtcaggagttcgagaccagcctggccaacatggtgaaaccccgtctctactaaaaacacaaaaactagccaggcgtggtggcaggcgcctgtagtcgcagctactcaggaggctgaggcagaattgcttgaacccaggaggtggaggttgcagtgagccgagatcacgccactgcactccagcctggcgacagagccaagactctgtctcaataaaaaaaaaaaaaagaagaaaaaaagaataatatcaattaaattagaataaaaagaactattacaaattatattttcattatcttgattgtggtgatggtttcatcagtgtatgtacgtgtgtgaaagagtatcaaattgtgtacagtttaaagctgctttaaaaaatgtgactcaaattgcaaaaaaatctattcctatgtaccttcttaggtattaaagccacaagagctacacaatggaaagaccataagagtggctctgtcactaactagctatgtgatcctgaacctattacttaacctctctgaaccccagagtccccacttaggaaacgaggatatcacaatctatctctgggacagtacagtgaaagtaccttccataacaagtccttactgaacatctacaaaatatgacttgtttactgtacaaagtaaagtatacctatataaagcattcattaaaacttgtgctttattactaagttacaatgtgagtaccaacaacaaacctaccttacatagtccaaaatgtacatatcactattatattttttcatctttctactttcaaactgtgtctttgtatttaaaatgctgctacacaatcccagcactttgggaggccaaagcaggcatatcacaaggtctggagtttgagatcagcctgcccaacataatgaaaccccgtctctactaaaaatacaaaaaattagccgggcgtggtggcaggtgcctgtaatcccagctactcaggagggtgaggcaggaaaatcgcttgaacctgggaggctgaagctgcagtgagccaagatcgcgccactgcactccagcctgggcaacagtgcgagactctgtctcaaaaaaaaaaaaaaaaaaagctgctacatagaagccaatatgcactgtagccaaaatgcactacatagtgcaaaatgtatttaaaatggacagtatgcagttgggtcttgcttcttaatccagtctgacaatctctgccttttaatcgggatgctttagtcaatttaaatgtatcataatgactgatattgttgaaatcaggcatttcattatggtatttttgtttttgatcatctcgtttgttttttatttctcttcctgccggcctgtcttcatttgggttaatcaatttttttttttttttttttttttttttttagcattccattagatattcctctcctggcatttaggttcatcttttaattttgagatttctcactagggatcacaactgtgactttaacttaaaacaatctattcagagttaatgttctacctactaaatgtcaagaacccaacttgtgtgccacacatacatgtactacacatgccaccactgcatgcatagtatttaaaaactgccaagaatttggacagatcttatatgcgaatttttttggactcactttctttgtagctgcctctcttccaggatttacccactaagtttcttgctgttctgttagcccagaactctgtatccttacatttcatgcaaataaggttgtggtattcttcaccaagtagcaggaggattacagagcaccctcagacaaaaacccaccaactcatgaatttcacaagatagttatgttttaagaataggctctcctccagtttgtctgcttttgatcactctccagtacctttaaagaaaaattaatgtattttgtccagatattatcattgttatctataggaaggtaactctacagtattgcaccattactagaagccagaatgccacgttacttttactacataaactccattctgaaaatgacttaactaggtaatttatgctactattaggtgtatttttcctttttattttagtagcagctttattcagatataatgcccacgccataaaatttatcctaaaaggataagttccgtggtttctagtacagagttgtataaccatcaccactacctaattttagaacattctcatcaccacaaaaagaaatcacataccctttagcatttgttccccatgctccttcccacaacccctggcaatcactaatctactttctgtatcaatggatttgattgcctggacatttcatacaaatggaatcatataatatgtggactttcatgtctggcttcttcacttagcatgtttttgagattcatccatgctgtagcatgtataaatactttactcctttttattgctgaataatattctactgtatggacataccccattttatctacctattcttccattcaaggacatttgggttgtttccactttggggatattatgataatgctataacaagcattcatgtacgtgtttttcatcttttggacacatacctaagaataaaattgctaggtgatatgggaactctatgattaacatctcgaactgctattttctaaagttgctgcacatcctaccagaagcgtattagaattccaatttctacttatccttcccaatgctattatttgtttgattttagccattttagtgtacgtgaaatgatatctcttgcttttgatttgcacttccctaatgactaataacattaagcatcttttcatgtgtttgttggtcatttgtatgcctccttcagggaactgtccaagtccttgcccctttttaaactagactgtctttgtattgttcagctgtagttctttacaaattctggatgttaagtagtacctttaatggatgtatgatgtgcaattttttcctcccatttgtgggctgctttttttttttttttttttttttggagacagggtctcactctgatgcccaggtaggcatgattaccacttgctgcagcctcaacctcctgggcaccagtgatcctcccacctcagcctcccaagcagcttggactacagatgtgcaccaccacaccaggcaaatttttaaattctttataaagacgaggtctcactacactgtttaggctggtctcgaaatcctaggctcaggtgattctcccaccttggcctcccaaagtgctgggattacaggtgtgagcgagccactatgcctggccacttttctacttccttgatggcgtattttgaagtacaaaatattttaattttgataaagtccaatttacctatatttcctcttgtcacttgtgcttttaaggtggtactatgaaaccagtgccaaggttacaaagatctacacagatgttttcttctgagaagtttacacattttagtttttacatgtatatctttaatcaactttgagttggtttttgcatactgtgtaaggctccagtattctcttgtatgtggatagtcatttgttccatttgttgaaaaaaaaaaactattccttccttgtaatactgttttgccacccttgctgaaaatcaattgacctacccacctaccaaaaaaaaaaaaaaaaaagaaaagaaaaaacccccgaaaatataactggtaaatgtgaaagtttctttctggactctcaattctattccattggtccatatgtctatccttatgccagtatcacacagtcttaattactataggtttgcttgttctgtaaattctgaaattgctaaatataaatatgagtccttcaacttagttcttatttttcaagttttgctttggttattcagggtcctttgcaattccatacaaatttcagaatcaacttgttgatatttcaaaaaaaaaaaaaaaagaagaggaagagaaaaagaagccaaaagaaaagaatagaaaaaaagaaaaaaggcaagtcagcttggattttatgggaaattgcattgaatctcttagttcatttggagattactgcagcttaacattaactcttccaatccatgaacatgaaatatatttccatttacttagatctttctttcaatgaagttgtagttttcagcatacaagtcttaaactttcagtaaacaatgaattcctgataaagaaaataagtcttacacttttgctgaatttattcctgagcattttattctttgtaatgctgttgtaacaaaattgttattttgttttttaagacggggtctcactctgtcacccccgctggagtgccagtggcgcaatcaccattcactgcagcctcaacctctccagctcaaggctccctcctctgcacccaagtagctgggactacaggcatatgctaccacacccagctttttaaatttttgattttatttatttttgagacagggtctcactctgttgcttatttagtctcacccaggctggaggctctactgctcatcatagtaacacaattacagttcactgtggtcttgacttcccaagctcaagtgatcctcccaccttagcctctagagtagctgggactacaggtacacaccatcagacctagctaattttggtattttttttgtagtgacgggatctagccatgttgcccaggctggtcttgaattcctgggctcaggcaacccacctgtctcagcctcctaaattttgggaagtataggcatgtataggccaccacacctggcctgttttaattttagattgcccattgctggtatactaaaatacaattgattttgtatactgatcttgtatcctgcaaccttgttgaaatcatttattagctctaatagtttttaagtgagttctttagaattttctatccagaagatcatatcatttgcaaataaagagttttaattcttattttccaacctggttatctttcatcttgttttcttgcctaattgtgttggctagaaaatctggtacaatactgaataggaagaacaacaatgaatacggttgtcttattcctgatcttagggggaaagctttacatttacaccattaatatgacataagctgtggatttttcagatgctcttcatcaagagaatgtgaagaatgcaaaataaaaccataataagacatctctacacacttggtaaaataatgaaaatttaaaagactggcaaaacaaagtattggtgagcatgtggaacaattagaattctcgcactgttggtgaatgtaaaataggacaaccaccttggaaaagaatttcaaagtttctaaatactgttgggctgggcacagtggctcacacctgtaatcccatcactttgggaggctgaggcaggtggatcacctgaggtcaggagttccagaccagcctggccaacgtggtgaaaccccatctctactaaaaataccaaaattagcagggcatggtggcgcacgtctgtaatcccagctactcaggaggctgaggcaggagaattgcttgaacccaagaggcagaggctgcaatgagctgagatcatgccattgcacttcagcctgggtgacaaaagcaagactctgtctcaaaataaataaagacagttaaatacacacttatatgacccagccactctgttcctaggtattgatacaacagagaaacacatagacttgtactgatccaaaagacatacacatagctttataaacaaatattcatagcagtcttacttacaattgccaaaaactagtaacaactcaaatggccaacggtaggtaaatggcctactgttgtggtatattcatataatgaatatgagtcagcaattaagaagaatgaactttaggtacacaaaatattaatgttaatattaagttttaaaaaaatcagacacaaaaggagtatgtattgtcatcacatttaaacgaaattctggaaaaggcaagctgatcaatgaaagaaagcagattaatatttgcctaagggttagggacaggaaggggttactgcaaagggatatggaggaacttttgggaagacagaaatatttacattttgattgcaatggtggttacaaggaggtaatcatttgtcaaaactcatcaagctaaatactgatgtgtattacttctgtaattttttaatgttaattattctgagaagtacttaaattatttgaagtcctttctaaattaatctgcctcaaagattttttcgatgatataattaccaatgtcctaattttttatcctattaataccatattatgcacttggatctgtgttgcttatcaacacttggggcggctgataaatattccctgtaattaaaaaaaattgtaagcagtcaaaaactaataaaccttcaagagtgttataaataaataaaatttacaataacatttacatgacacctattttaatgttttgtccattttatgttccaatgataattaggactaagtggtgagcagttcatgtaaaaatgactttacagtagttataaaaccaaactcacactgctgaagtctactaggcagaagaactgaacaagagcaggaaggtgttatatattttctgaaggtccctaaaacaactctaggcaccagataactcctacctcaccaaaagaaaaaagaaaggaagaagtaaccatattctgaaagtctatagcaccaatactatcccattcatagtcatctttttgagacagctcttgctctgtcacccagtctggaatgcagtagtgtgatcatggctcgctgcagcctcaacctcccaggctcaggtgatcctcccacctcaacctcccaagtagctgggaccacaggtgtgtgccactaaacccaggctaatttttttttttttaagggatggggttctgccatattgcccaggctagtctcaaactcctgcgctcaagtgatccccctgcctcagcctcccaaagtgctaggattacaggtgtgacccaccacaccaggtcttagttctttttcttgatacaagtcagcagagactccaatttctccacttcaataaattaatggattctttaaaaagagaaaaagattaattaaagccacatgagccacagccccaacaatctacagttataccccgaattcaacacctggcagcagtcataactaggggtctcctataacacctaggcctggatgtccagctgcctggtttcctctggtttataaattcagaacttttagatttctcttttgctcattctcccttctctgccttttagacaagagagctctggacctcctctcaaggctatctttaccctaagcagatctgcccaacatcccttcctccctaatacctgcactgctgtaaacactatacagttctctcagaaataggtccaatatttactatgttaccaaaacaaaagaaaagcatagggagggatatgttggttaaattatatttaaagtttagccatgaccacaagcatatcatgtcctcacataatgtcatcacattcacaaatacaaaaacttagaatgaaggtgataaacctggctatgccccctaactgctgcatggagctatgtctaacgttatcagaagactcctgcactggtaactaatacaactaattaggaatgtgttctcattatgaaaatattcggccaggcatggtggctcatgcctgtaatcccagcacttgggaggccaaggcaggtggattacctgaggtcaacagttcaagactagcctgaccaacctggtgaaaccctgcctctactaaaaatacaaaaatttgccacttatggtggcacacacctgtaatcccagctccttgggaggctgaggcaggagcatcccttgaactgggaggcggaggttgcagtgagcggagatcatgccattgcactccagagtgagtgcactcagacgacagagtgagactctgtctcaaaaaaaaaaaaaaaaaaaaaaaagaaaaaagaaaaaagaatatattctagctatttttgacaaacactaagcaatatactaaagaatttattaccaggagagaaatatttagtaagttaaaatagtgcttcccaaccactttcatatcatggcatgcacagaaaatatttatacagcatactgagataaaaggacaaggctacataggctccaccacccaaatccccgggtggccacccctagggcagcacaccacatgggaaacactgaccaaacaggctctcatgctaataccctgggtcactgtgacaaactagggagaagttcatccatatggctgtacactgtcacaaacaaaccagctttaaaaaatatttgtttctgcttttctaacttatacatcttcatcaaaccatgaaacattcaaggcccagttcatccccaccaagaagccctcgcaaatctctaaggctgtaattcacacctatcttttctctgtgttcccaaacttcctttactcttactaaactatcctgttctgttttatagttgcctttagctattatttaccttattaaatatgtcccttgaatagaaggatcttgtttcattcatttttatttccttcttgctccacaatattgaaaaaagagtttgtacaacctgtttgttcaatcggacttggggtgggtcatattcagtgacaatgctttttgtactacaatagcccatgtactttctccctctgtattccgaaattggatttatttagttccaagcctctcaaatatcccaaattttccagtttcaagagttcaacaggatacacaaaaatgtttgtttgcactagccccacatccacaaaatttagaaaacaaaagcaaatatccagcccctatcgaacttttttattttttatttttgtattgttagtagagacaagagtttcgccatgttgaccaggctggtctcgaactcctggcctcaagagatccacccacctcagcctcccaaagtgctgggattatatgcatgagctaccacgccaggctgtacccctacagaactttaacatccaagtatcaattctttcttccaagcaaaaacaaggtttccagaactcaacagataactgaaaaccacactgttgttaccagccatagtccctgacagtaactttaaattgcccaagagcagtgaggaagcattttaaattattttcacatctattgaaggattccagccaagagaatttattcttattatacaggagtaaatacgcattttatcattaaatagtatgataatcctaactaggaattatcagcttataaattttctctgtaatatctgtgaatctatctgaatgctaagattttatttagaatcacaatttttattttcatcttccccttccctttaaaaaatagttaatttttaactactagtaagtagaataaatagaaaaataactataagtgaatacttaatatgaattagtacacaaattaagttatacaaggatcattcccaaaatatttattgaaaaatgcttctatccatttctgatgtttttctgacccttgtttaaaataccagatgctgaagttaactaaaatttatttatgcataatctaaaaagacaaaaaaagcacctcaataagcattcccaagtatatattatttcaaaaccaagatacatatagtcatggaagtagtttcaaatttacagtcagttcaaatttataaaaagatactaactgtatagtccattgctctctgctagctgaggttaacactgtataaaagctggtttctactttttctctaccacccatatatgcatctctacaatctgtagcccaatacttagccaacatgatcatccttctcagtctactgaattccttttttcctgctgattcaaatgttgaggaatgcacatgcaatatccaatccctctaattatttcaatgcctgttcagctaccttcctccatactctattcagctttctacctttcagtccctattattatcattttgcataaagaaaaataacaacagtatctgtcttaacaccctctgtaaacaccacaaagatatgctgaagagttggatctgtaccccttttgtgtttctgaaacaggaaatgcaaagaaagtatacaggttccaggacctcctaataccaaaatccaaggatgcataagtccctttatataaaatggcatagtatttgcatataacctatgcactcctcccacatattttaaaatcatctctagattacttataatacctaatattatataaatgccacataaacagttgttacactatttatttttttctttatttgagacagggtctcactctgtcacgtgggctggagtgcagtagtgcagtgcttggtgaagccttgacctcctcaggtcaaacaatccttgtgcctcagcctcccaaggagcttggactacaggcacacgacaatgcacccagatgatttttttttttttttgtattttttgtagaggtagggtctcactttgttgcccaggctggtctagaactcctggcttcaagcagtcctcccacctaggcctctcaaagtgctgagattacgggcatgagccacatgcctggcccgtattattttttagtaaaatcactttccaaaatactgcaatatgaggaaacctttattccaaaaagtctactcataataacttataaacatctttggaagttaaaaattaaccacatcaacctgcttagcccacataacccacattaacccacatcaacctgcttagcccacataatccacattaacccatattgtggtttatgttttaaaaggagaaaaaacactgaaactaccatatgtcttaccttttaggcatacatgttaaaattttggcagatgaaacataatactgatagatgacgcttcaaaataatgcagggaagagtagaagtgggtagagattgttaaatcaagtttagtctaaagcagtctccttacatatttgaagttcagtctaaaggtttctctgtacatagtgaactataaatgtatctaaatggaggtgtaaacagactgtaacctacttttgtgccaatcaccaagttttggccagttaaaaggggccaactgttcaaaccatgttcaaataaggcaaatgccgagctgtaaccaatctgactgtttctgtacctctgtctatacatcttcttccaccacctggctgtgctggagtctctctgaacatactgtggctcaggaggctgccctattcacgaatcattctttgctcagttgaactctttaatttgactaaggactttcttttaacaagatataaattacacaaacgaccataaattataattgttttaaaatgccacatgggagttcaatatattattctctctacttttacatatgtttgaaagttttataaaagagagcttttgtttttttgttgttgttttttctgagacagtacaatctcagctcactgtggcctccacctcatggactaaagagatcctcccacctcagcctcccaagctgggactacggttgtgaaccaccatgcttgcctactttttaaattttgtgtagagatgaggtctcactgtattgcctaggctggtcttgaactcctagtctcaagcaatcctccctcctctgtcttccaaagtgctgggattacaggtgtgagccactgtgcccagccagaatttttgttaagtgtgttatgataaaacacataattaaaaacaagtgatttttgattttctgaaatcagaaaacctggttaccaactagatgagtggacaacattcattatttttctacgccttaaattttcacatctgtgaaaaaggagttggactcattaaattccaacgttcctgctagttccattttttttttttaacaattcaactgaatgacttccacactttgaatttggtttaacaattctaactaaaatccagaatgcattcatagctaaatcttatataattaactgaaaattgttcattactgttaccaaaataacaatctagtacagtacttacctcagctgggccttcattcctatataaatcctattttgcttaccctgaaacacctttccttcaagtattacctcttagacccttcattctctatagttaacgttgtcaaagaaaatagaggccactaagtataatttgttccagtttccctacccctaatgcagcccatcctcatttctgcctgtacttcaagtcctttccacctgaggctgcttcaagatctctccacatctcacacatctcttatatttcttattcccttccccaacaactccctacttactctatctaggctcagtcgtttgttccttttctaaccaagtcctcaggtctcttttgctctggcttcttcagtttagcctagtcaacaccacccttcttaacaaataaaaaacaaacgaacagccttctttccaccctacgtcttcctcaagctaacctgtgattcctccttcccatgactaccaaatatttaaatcaaagctctaactagtctaaatagctcaactccaactcactccttagctcatcatgatctagcttccagcctccaccaccctcagttttcccttctcactggcccccaaagagcaaatacaatgaatggcttattgtaaggtctcatcatgcctctcctctctgtagcatttgatactgcaattactgcccctccttcaggaaactctcctccctaagttcttatacaccattttcctgctaagcttcctacagactccctcagtaccattttcacctcttctcctaatatgatttggttcctcagggttctttcctcccctgctcctctttccttcttatccctacaatccctcacctatattatcatcttactctagccattgcttgagctattaatcttcaccactggatacgctagcctagaagggcctgtgagcaaaatctagacccccaactgatttcataaataaagctttattagaatacaaccacactcatttgtttgcctacagtctatggctgcttttgcgctcaagacacaggtgaatagctgcaatacaagcagaatggccctcaaagccctaatatttaggcttttaaaaaatattatggctctttacaaaaaacttgccaacctctattctataaggtaaaatatgccaaaagattagtcctaataactttttctgcttttcaatctcagtgccaacactatagtcaggccacccatctgagaccttgagggttttctgttactcccaaactccccatctgagaccttgagggttttctgttactcccaaactctcttctcatcttcaccaatccatcccctatggtataaccaaagcaatgcttctaaatgcacaaatctatttcactgtttaaaatgttccccagcgaaaaggtttttcacaatctggctcttgtctgtcctacccaaatttcaaattactccacacctgaatattgaaaaatatttctttttttttttttttttttaagatggagtctcactccattgcccaggctggagtgcagtggtgcaatctcggctcactgcaacctctgcctcccaggttcaagcgattctcctgcctcagcctctgaagcagctgggactacaggtgcacgccaccacacccggctaattattgtatttttagtagagacagcgtttcaccatgttggccaggctggtctcaaactcctgacctcaggtgatccacctgcctcaacctcccaaagtgctgggattacaggtgtaaggccaccgcgtccagccagaaatactgttactttagttccccagaatctatcacactatctcttacttccaggcttgcccaagatttaccataaatacctacacatttttctactttcagctcaggcacaatcacctccatgaagccttcagtgacttacccaggccaactcaggtgattctttccccatgtgcccgctccactaggtacacacttccattacaggaaatatttacttgctttcacataatctgcctactagtctatacattccttgagcaggaaccctgaggtagagtaggaaaatggctattaagggcatggagttttaaagttggaaatctgggactcagtgccagttctgccccttcctaactgtatgttcttaacaaattaagaagaaaatgaagaaatgaagaactcattttcttcctctgtataatgtaaactttgtgaggattatttaaggttattcttataaacacagtgccttacacatagttaagtgctcaacaattactggttatcattattttcattgttttatccctcacactcagtaaagaattcgaatagctgctgagtgacataactgaagcaagctagttctgcactgttttcagctgcatactgaatattttcatctgaacaacacttggatcccgagaactcattatttttatgcccaaactgtttcaattagagcaatcaacttgttaaggtttgtccaggactttctctgtttgaacactgaaagtcctgtatactgggaactacctcagttccaggcaaaccaagacagttgatcaccttagagttatgttgcaaacaacagcaactgacttgggtaaatttaagaagaaataaagggaagagtgaatttattggtagaatgtatagagtaattcacaaaaccaagacaaagctgaagaatcaagcctacgaaagcaactcccacatatctagccggcaggaattaacggatggttaccttcacagtacttctgtcaagatgaatcaattaggtctcagtatcagctcactcaagatttaaatgccagggacaaattagcctaatttgtgttagccagaaaaatgtgaggcacattaattaatcagaggcaggagcacctacattaaaaatcccaccataagatagccaatggcagaaaagtagcttccaaaggccaaatcagaaggttgtttccaaaagcagggggaatggatacaatgcccctcatatcagctgcagcttaaacatgccaagcctttagactccatgacacagtcactgttattcatactatttttctttctgagttggcaaactcatccttcaagacctacctcaagtatgaccttctgtgtaaccttactaatttccccaggtacaatcacactttttctatactcttatagtactttacaaattatctacctgtatcatagaacttaccacactgtacactagccatatgcttaagtatcagtctctcccactaaactgaacttccttagatcagggaatattttcatatttataatctttggcacctaatgatgtctacatagcatgtagaaaatactaaataggctgcgcgcggtggctcatgcctgtaatcccagcactttgggaggctgaggtaggtgaatcacttgagcctaagagtttgagaccagcttggacaacacggcgaaaccctgtctctacaaaaaataaaaaaattagctgggcgtggtggcgtgcacctgtccagctacttgagaggatcactcgagcctgggaagttaaggatgcagtgagccgtgattgtgccactgtactccagcctgggtgacagagcaagaccctgtctcaaagaaaaaaaaaaagctaaataaatgtttaataaatctgtttcccaagtcactagaatatgtaaagcatcaaataaaaagaaacataggggctaccacaagtaaatatgctgacagtatcaaaagaaagctgatagaccaaaagcaagggaaggacaagccaaaaaaattaagaagagcaaaaactccacaagcgtaaaaatcaagaagaaaattctgttaatttaacaacctgaaggcatcacttatgtaaaagcaaaacccaatatccatatgcataatggtgattctcaagaaccaagaaaacaactaaattatattctatttaaggcaagtgtcaaaataaagtaaaatctagtatgtatacaacctccctaacccagaaaaccaagaatgattaattccaagtaaatatagtcatgatttattttaccatattttaactgctgatgttggctatgctgtaagaaaatttttcttaacagcaaaactgcaagaaaggatagctacatcctccttatacttttaatattccttcacctccacttgaaaatgagaatacagtcctccctctgtatcctcgggggggttggctccagatgctccctcccccgaagatactaaaatctgcagatgctcaaatctcttctataaaatggcacagtacagtcagccctacgaatccacaggttacaaagggccagctgtacagccaaaccgtatgctaactaaacaaaaggtcaactgaggagtggtgtcagtcatagaaagaaaatcctactgactctgaagttagaagttctagatatacactttgtaactcctttactggataccaagaagttacttttttttccacttcttgaaatgtcatcaatttcatgtcccatttcccccaaataactaaaattcacttcacaaactgttaagtaactttcacattgatggcattaaactatttgttctttatcacctgaaccctacgatcattcttattatcattactgagatatattctaaggtacacactaccaccaactgaagtttaaataaattaatagaagcttaacttgaagctaatcaagactttaaatcaaacttccagtttagactgggctcagtggctcatggctataatcccagcattttgggagattgaggagggaggactgcttgaggacaggagttcaagaccagcctgggcaacacagcaagaccccatcgctacaaaaagtaaataagctggacatggtagtgtgcacctgtagtcctagctactcaagacgctgaggcaggaggatcgcttgagccatgatcgtgtcactgcactccagcccaggtaacagcaagattctgtctcaaaaataatgtttaaaaatttttttttaaaaaaacttccagattacaaaaaatctgaagggtggtaaaaaaacaaataagaggaaccagttaagcaccaccagaaggaaacagacaaacccagtaattaggacagtctattaggctaaatatgaaattgccaatacttggctgttgttacaaacctggaaaaaagcaatttcatatagtgcaatttaataaaagaaaactgacccgaacaaattagtggcatttttaaatggttgggagacaacagactaaagttggaaacaatccaagtattcatctatagatgaatgggtaaacaaaatgtggtatatacatacaatagaatgttacttagccatacaaattagccttaatcactaattcattcactatgtatataccttaatctcccagaactttacctgtcataataaaaagcttggagttgatttgggaagcagtaggaaaaggcactaaaagagtaaacatttcagttcaaaaatacacatgggaaaaattattgtgtctgcggtgcctacgatgtatttattcaaggaatattttagtgcttgcttggttctagccactgtactaagtggtaggcaatgaagatacatagtctgtgccctcaaaaagctcacaatctagtaggaaaaataaaatctaattaaaatacattatcataattgcaacgagaaagatacactcagacttcttccaggagcaaagaatggtacctacccagagttgagtatttaaaagtggtaggaattagccaggcaacaggaggcagagaaggatattccagtcagcaagatggccctgagaatagaaatagcactggcgaggaggggcaggcgggattccagattatgtataagcatataagaagttcagtgttgctagggcttaagggggtgggggaggaaggctgaatctggagaaataatcaggcatcaggctcactgaaaaatctcataaactaaaggaagaaaaccactttggagatagtttttaaacaggaaggtgacaggtaataaggcctaaagtaggctggaggcagcagaatatagaggcagggccaaaatccagagacagcacagagattcgagctacataactggcatctgactgaatgtggaagaggagaagtccaagaagcctctcaagtttcaaattcaggtcacagtgagggtgatgatgccataaacagaaaaaagaaaaaacaaaggcagaacatggctttaaacactttgagcttgagaagctaaaaagatgctcatgtgaataatttccagcagatgattttatgaaatttaagtccccgcacattgaaatgatgattaaagccaagggagttgctgatatgagcaagaaaaacagtctacagataaaagaatcgtagacagaatcccaagccatgcctactacattcaaagggtaggaagaagacttaccaaagctgactgaaaaagagtactccaagagaaccaggaagcagtatatgccccattagtgaattcatgaaaaaaaaaaagtttgtttgctatatggcatatagattcctgaaacactttacactctccaaacttaggaagaagagggaaatgcacaggatggatggtcgttaagcacctttagacactgcatatggttaaacagagccaagaggcagaacatgggtgcatggccaatatgcatactcctgggcttgatccgttcaactgtttctgtactttatgttcaactgttgttatttaagagtgctaaacattaatgtgatactaaaaatcacatatgaaccaatatgaactttgccttaacatttttttattaaccattcaagtatgagcgagttcatgttacagaaatacattataggagaacaggctgttcaaggagggctaggcaacagtatcaatgccatggagtcaacaccaaaagaaaattaatgtcttagaataatactgaacctttcattcccaaatgtagacttttttcaggtatatcatctagtctctcttctcattaagtttcatgtttcaagttacatccaaggtatctattctcactgagcttctcaacagagcccaaatactttaatagctatacaaacacagaatttgttgtacatcacagcaatttatcccaaataggtgaaggaaaattcacctaggaaaacactagagaggaggaaaagaatagggactgatagtaccaagtatactgtaagtcaggaaaggctcatggagaacttttaaagtttttttttgtttttggtttttaactagaatgacatggtgtggcagaattgtaatcttggtgttccagagatatatgaaggagtctcactgaagagataggttgccagagtgaaccccaactcaacagatagtcaaaagaaggcacacagaacagcatatacaaaggcatgaagaagaaactactggttactcaagcatctccagtactttatcacagctggcacaaaggagatataaggaaaagtgcaaggtgaggtaaaaaaggtaaggtcttacaactatgtgtggcatgctaaggacttttatcctgaagtcaatgggaaggatcataaacaggaaagtaacacagaaagatatgagaaagatcaatccacaagatacactggggagagaagatactgaacacagaagagctaggtacactattatacttgttcaggcaacaaagataagggtctaaactaggggcagaggaagtaaggttggtaacaggtacaaacatgagggttcttcagataactaatacaaagaagggtgaaggaggggaagagaagggagtcaaggatagaatcttaaacttggacaatcagatagtgccacttagcactggaggttccagagacagaagcaagtctggtagagctaactgaattttgcaggtgagaaaatatatattagccctggtatcagaaactaaagcataaagcttaagtgttaagcccaaagatacggattatcattttttggtaaaaccaaccaactggctccttgctgataagaaggaaactttgcaagagtaaaaagataaaaaggcaaataaatctaatagtaaagttcatcaaaaatttgcaaggttttaaagtatagaaatagcaatttctgtgatatagtcgatatttcttcaatattttccccattcactaactttcaggcgtggtttgtacatgtcaagtcttagactcccttcggtggagtacagcacagtaagcaagagttctagctttagcatcaagctttatttgtttgtttttgagacagagtttcactctgtcgcccagacttgagtgcagtggcatgaccacagctcattgtaacctctgcctccccggttcaagtgattctctcgcctcagcctcccttgtagctgggattacaggcatgagccaccaggaccggctaatttttgtattttttttttttttttgagacggagtttcgctctgtcgcccaggctggagtgcagtggtgcgatcttgactcactgcaagctccgcctcccgggttcacgccattctcctgcctcagcctcccgtgtagctgggactacaggcacgcgccaccatgcccggctaatttttgtatttttagtagagacggggtttcaccatgttggccaggctggtctcgaactcctgacctcgggtgatccacctgcctcggcctcccaaagtgctgggattacaggcgttagccattgcgcccagccgcttagcataaagctttgatatattgtaagtccaggctttgccacttaacacccgatggaagacttaaggccacttacttaagggttgtaggcctcaagttgcctcagcagtaaatggggataataatagtacttacttgatataggactgttgtgaagattaaatagataatctatataaagtacttagcactgatatactgtaaacaataaatgttaaggtttttaaaataattaattactgttactaatgaaaatgtcacacccttgaggtatacagcagcaagaaaatgagttgacctggattgcagttacctgagcatttgttttgtaattattcattaaacagaacatttctgttttgcacacttttctataagttatctttgaaaacaggaaaagtttttaagaatcaatgccttacatgaaaaggtctagcattaaaatgcacattccaggaccgggcatggtgactcatgcccctaatcccaacacttttagaggccaaggcaggaggataacttgagctagcagtttgaaaccagcctgggcaacatggcaaaaccccgtctctacaaaaaacacaaaaattagccaggtgtggtggcatgtgcctgtagtcccagctactcaagaggctgagatggaaggacggcttgagcctgggaggaggcgaaggttatagtgagccgagattgggccactgcactccacccttggcgacagagccagaccctctttttttttttttttttttttaaaaaaaaaaagcacattccagaacaaataaaaggaaatgtttccctttcaatatgtacttcctagtttttgctacaaaatgcatcccctacccaagctccaaatttctatcagtgatgataattactccctcccttcctccatttataaacctcagaataacctttactccctttctcttcagtgatctttataaagagaatttgaaggaggaggaagagggaggaagaacagcatcatcaaatcctcattccaggttgtagccattcccagtctcaattttttggaaaactcttctttgcagatcagacaacagcgctatttctccaaaatgaattctaggtattactgccctgtcaccctttccattgctctaatcatgttacatctcctctttgctctggaataaattccttcacatctccctattaagaaaaagcttccaagcaactctttgccacaagatattcttgcatcaacacaggccacctggaagtctcctctctttaatataatcactcttcttttttacctggatatttattcaccagttaacatgccccttttaagtttggtacatatttcctataagattcactaacctcattttttttttcctctccaaagatctcttaaagtctctctcgattgaatgacaaagaaattttcttcctcaaccctctctctactcaaatcccctggcataactctatccttttattttctttaacaagtatggatcttattcttgcacctaacatcttgtgtatcagctgcttctataatttataacatgttttagtttttgtctatcctatatgtgaaaaaataggcatcatagcttatcaaagtgcatctcactgttttggaacagcctgataaccacaactactcagttacagagctaagttgtactgtttctaatggacaagactaagcatggttatctactcttagatatgcctaaatccccaataaaggcccttcatcagatttgaccccagtttaccctttagtctctctctctcctacatttctctcaggactcttcaattactgctccctctagtctggaatgcccctttcttccaccagccttctcccgccctttgcctggccacctttctttcatccttcacaatcagctcactcccattcatccattagaaatcaaccagagtatcttccctttctgctcacctccaagtagtttttttggcatgcattttcggaatactatactgtaacaattgttgttctgcattgtaattatcacccccactggactgtaaactccctgaagtacagactgcatcttattccttatccccaagacctaacattgatagatacccaatagacaattagtgaataaataatacccatatccactgagtgacatgcacaggctacataagcacactgaggttttttatctaaagttccagctgggtgtgacgactagcatctgtagttcgaacactttggaaggccgaggcgggagaatcactggagcccaggagttcaagacaagcttgggcaacaaagcgagaccccgtctctaaaaaagattaaaaaattagccaggtgtggtggtgtccgcctgtagtcccagctacttgggaggccatggtgggaagattccttgaacctagaagtttgagcttgcagctgagctatgagtgcctgagcactccaacttgggtaaaggagcaagactccgtctcaaaaaatactttactcatgtaaagtggggataatgccacacttcatatacttgttacacagattaaataaggtatcatgaagctcgtaacagtgtctgccacattagaactaccatttgaatgtctatttcatgttttagttacactatagaatcccgagaaatgtaatgttgtgaccaataccaggctgaatggcttagcaaccatgctctttttcatgcatctaaaagtcacgggttacattcttatcagcaaatatttgttgtgtacctattatgtgcaggagtccttactaagtatcactgagctaccagaacacaatagaggtaaacaatgaaacaaaaacctgtaccaatatccgagagaagaatgttactggtttttctgtacaaacaatgagtatttttcaataaatttttatttggaacaggataggcttcaagaaaaattcctaatgggaaaagttcaaaattaacacttgtcatcaagtggaccaataacaggaggcagttccaaaatttcttgttcctattcccaagttttactttcgcttagatgtatttcttacaaagggtatttaaccatgaccaggaaagaatatatgatctttatttgactcatttaaatgggaattccacggatatctccctaggttctttcctactagtatttaattttgtagctctgaaaaacggcctgagtttgtctgtttctctacaaaatagaacactgaatggtatatttaccccacaaccttccttaagacaggataaaacacacctcttaatcacactagcttatcaaaaattacaaaactgcaaatcatgtcgcctagtattagcaaagaaggctgcggccttaaaaccattttccccctaacaaatccaaaggtcacggtcccagtgaagtttgtgcattatacttactgttttcagtagctgcagagagacctctagcgctgcctcaataagccgagtttgcaaatagtacctgctaatgtcaccttaatgagacaatggcaacatgctgagtagcaactaactgagtgaccgcgatgaatgtttagttttgcaaccacttggaaattctactagcttggagcaagaggtatgtaagagaattatgaacctgtgtatccaatttattttagtaaaacgtgtcaaagaaattatcaccctatgcacaccccactccaagaaaggctaagaaaacaagtcctatgagcggaggtcggagcaacctcttttccgaagcctgaacacaatagatggcaaactattgtccaccttcagctcgctccaaatgccagcagttgcaggagtatgagctgcaacagctcggcacgactagtccaaagacgagcactggaatataagaaaatggtcctggcgcatcctaccctcccccatcgatcaccctcaaacaagtcagttacccggctggtccccacccccctctgcgggccgccaccgcccgcctgggcccggctcgcagaaggtaggagcccggaccggcagagccgaggctccatgtgagccgcgcgggaggcgcagagggggctgcaccggacggaaggttgcaccggtggcgggcgcaagcagcggccgccccctcggctgtgcggtcggagggcccgggcggcagcatccccgttcatccgggcggccctggcccgcggaccccgcctcagctccacatcccctcctcgccgacaccaggccgcgcccgcgtgacggggccgaaaacgccggcatttcccggtcgccgcgccggcagctccggggggtgactgcagcccggccggcgtctcgccgcccgctccgcccagcccggggccgcggtgacgggaggcggcggccaactccggccgaccacaagccgacgagaaccagcccggcgccggccccccgcccctccccgcgtcgccgggccggcgcggccaggcgggcccagaccgcggaagcacactcacttccacatcgcggcccttgttcttgaagctcttgatgcggtggttctccaagctggggttctcggccatggctgcgcgcggctccggcggcggctactcctgcggctgcggcggcggcggcggcgaatcttggagcgggagggggaggagggggagagcgggaggggggagggggagagaagagcacgttctgtgacgcctccgagcgcgaggaggcagtagcaccgggggaggcgcggaccaacagccgggccgggtggggcgggaacggagctgagagcggcgcgcggccgcggaggctggcgacacgtgaccgggggcggtgaccggcttgggcgttcgccgggctatacgtgcccgttggttctcgggatgaccctgccctcttcccctgcaagggctctccacaacccctcggtgctgcaagttttgtgccagaaatggagccggacctggcgacttttactgcccctcaggcgcggggcggcggtcgtcaactacagttcccatcatgccacgatccgcctggagtaattctccacgcctagtgagaacgaggagaatgccgggacccttccgcgcgcggctctttgcgcgccgcgctcatgttgctgggcacaaagctccgcccccacaaggccgcctctgggcggggaagagcgggggagcgtccctggcaccttgcgccctatcaggaggaagagggcgggccttcctgggagcgcacctcgctgcctgtagctagaagatcagaaaaggaacaaccgcgagtgctttgcagtctcgcttttttgggggtcttctcaaatagccaccttcattcgctcttcccatgctctgcttcagttttataaatagcatttctacctgacatgtacatgtgtatgtatgtgatacgagtgtttatatgcgttacctaggtgcccgcgcggaaattcagctcaatgagagcaggtactttggttgaattactgctgaatctctagtgtcaaaacaatgcctaccacgtcgtagatacgcaatacttgttgaactggcgctttagtgtcgcccagtttcttcatcatccttccaagcccggttctgcaaccttcactctggcagtccctgtatttacatgccccccaacacttcttgttctaccaccacacagaatcttagccttcaggcagcagcccagccctggtccgcagactctcctgtgtagcactcccactccctctgggggcatcgaaagaatgaaagagggaaatttggatggattacactgataaagagctgctttcggccgggtgtggtggctcacgcctgtaatcccagcactttgggaggccgaggagggcagatcacaaggtcaagagaccgagaccagtctggccaaccatggcccgcatggtgaaaccccttctttactaaatatacaaaaattagctgggcgtggtggcgcatgcctggaggctgaggcaggagaatcgcttgaacccggtaggcggaggttgcagcgagccgagatggcgccactgcactccagcctggcgacagagggagactctgtctcaaacaaaacaacaaaaacaacaacaacaaaaacaaaaagctactttctggagcaggtgggcttcatttgcttgtatgttaattttcagaatctatggtagacatgagcaggtatgtaatgttgtagtacttataattgaactgaggtcaaaagttggtaggactataccatgaagagatcaaaaaggacaatctttaaagcgaaagggccttggctgggcgcggtggctcatgcctgtaatcccagcactttgggaggtcgaggtgggtggatcacaaggtcaggaggtcgagaccagcctggccaacatggtgaaaccccacctctactaaaaaaaatacaaaaattagacgggcatatggcgcatacctgtaatctcagctacttgggagcctgaggcaggagaattgcttgaacctgggaggcggaggttgcagtgagctgagatcgtgtcactgcactccagcctaggcgacagagtgagactccatccccaaaaaataaaaataaaaaattcaaacaacccaacaaaaacatgcaaaggacactgatcacagaaaaagaataaatatatgaggagatacagaaaaaaaaaaaaaaaaaaaagcgaaagggccttaaagaacctgaggcccagaagtcaggaattcagaagcctttggtggccaagctatgtccaggggcattcgtcttgtgagtggtggggtgtggcctattgataaacacaggcttcagatcctctggtcatactggactgtggcccagtgttgccagaagattccacttttcaaggaaaaccaaaaaggtagattctttttctctttatttttaaatgttaattcacattttgttaatggacttaagcatttcagtcacttcagaatatcaggtcctcagtttgcaacacctgatcttagtctaaccactcatttgaagggaaacacacacacacacaccagctatgaatttagaaggaatacattaggcagggcacagtggctcatgcctgtaatcccagcactttgggaggctgaggtgggaggatcacctgaggtcaggagtttgagaccagtctggccaaccatggcccacatagtgaaaccctttctctacaaaaatacaaaaattaggcaggcatggtggtgcatgcctgtagtcacaggtgctcaggaagctgaggcaggagaatcgcttgaacctgggaggcggaggttgcagtgagttgagattgcgccactgcactccagcctgggtaacagaatgagactctgtctcaaaaaaaagaaaaaagaaagaatacattagctcaactctgggttttaaggaaacagaacttgtgtgtttgccattctccttggctaaatggaagagaaattttcagactgttgctcagtctctattataatttagtaggtattcccttttcaggttactttatgccacctttcttcacacccagtccaaagcagggctgcccttttgcctggatctagtttactcatttttattctttgccagtacccctggtaacttcagcattcacaaatgtggcaccctgacaccacagtctttctacatccttaacttcaccaagttttttaccactcaagtggtaaaaagtgcaagcctgcaccagaccttggagaccttaatctctgggaaatgaccacctccagggactcaaatttggtgcttctcattgttagaaactatctccttctcttttgcctcactctaatcatcatccttggcctgaaacttctctggacagctcttcttttaaatggatttattttccacacatattgtgagtgtctactgtataccaagcattgtattcatcgggcacatgtatgaaggactagggggtctcgggggagacaggaaggaagggccctcagcccaggggtcaatcaaatcctctgactcactctccaccttcccaaggcatggggagtcatgccagcagtcagtcaggtagcagtatgccgtaggcaacacaagcataacagatgggaaaaggacttcatgatttgcctcctaagtcagcttctttctgcaaactcacccctctattactggcataaccattcttccagggacacctctccaagctaagagccgtctttacttcttgtctctctccctcaactccctcacctagtcaccatgttaattcaccactcagtgtttctggcatctctctcttcttcccatgccacccacgagactaccttaacacctcctaagcagtccacctgcctccccaatccctccacagcaatctgactcacttctccagatcttcctgacttcatctctgctcccaatcagcatacccttctcctctgccattgtctgtcaaatcatttataaactcagtctagggccaggctccgtggctcacgcctgtaatctcagcactttaggaggccgaggcgggtggatcacctgaggtcaagagttcaagaccaggccaggcgcagtggctcatgcctgtaatcccagcgctttgggaggccgaggcaggtggatcacgaggtcaggagatcgagaccatcctggccaacatggtgaaaccccgtctctactaaaaatacaaaaaaattagccaggcgtggtggcgggtacctgtagtcccagctactcgggaggctgaggcaggagaatggcctgaacccaggaggcggagcttgcagtgagccgagatcaggccactgcactccagcctgggcaactgagcaagactccatcaaaaaaaaaaaaaaaaaaaaggagttcaagaccagcctgaccaacatggtgaaaccccgtctctactaaaaaaaatacaaaaagttagccaggcacggtgccaacgcctgtaatcccagctacttggaacgctgaggcaggagaatcgcttgaacctggaaaagggaggttacagtgagccgagatcgcaccactgcactccagcctgggcaacaagagcaaaactccacctcaaaaaatatacatattaaaataaataaacttgtctagtggttaagatcatatgtgatgcagccacagtgcaagatacttttttcttatttttggttcccctgcacattgctcatgcttcagctaacatgttctgctcacctttttccaagtatatcttaacctttccagtttttacatctttgccatttgacttgctcagatggccctgcctctgtctctgcctgtcaacatcgcttcctctttgaatactcatcccacatggtcaccttctctatgaagctttcccagcgtggtactgtggaaggatcttcagaacctgaaaattcaggtcccagggctgatcctatcagatcaagcccaggtaagtcaattatctgccctcaatcctcttttcatctacaagtaaggatcctgaatcactggggttttgtgagaatcaaattctaaaatgcatgtggaagtgctttgaaattgctctattaatattagttgttactatcttcctagccaggagtaatatgtttccctctgaacctcagaagaactttacttatggttttgtattgctgcaatttgtgtagtcttatctctctcttacctattgctatggtgtaaacatctatgtccctccaaaattcatatgttggaagctgatacccaatgtgctagtattaacacgtggagtcttttgggaagtaatgaagttttcatagctctgccctcatgaatggattagtgctcttataaaagaggctgcagccagtgtgtacctgtggtcccagctacttgggagactgaagtaggaggatcatttgaggccaggagttcaaggctatagtgggctctgatcacacttgtgaccagccactgcactccagtctgggcaacatagcaggaccccatctccaaaaaaaaaaaaatgttgaagggagcgccgtagtgcctgttgcccttctgtctcttccaccatgtgaggacacagtgttcatccctcctgccatgtgaggacacagtgttcatccctcctgccatgtgaggacacagcaacaagcagagagcagccttcaccaaacacagaatctgctgggaccttggtcttggactccagaactgtaagaaataagtttctgttggccgggcggggtggctcacgcctgtaatcccagcactttgggaagctgaggcgggcggatcacaaggtcaggagatcgagaccatcctggctaacatggtgaaaccccgtctctattaaaaatacaaaaaattagctgggtgcggtggcgggcgcctatagtcccagctactcgggaggctgaggcaggagaatggcgtgaacccgggaggcggagcttgcagtgagccgagatcgcaccgctgcactccagcctgggtgagagagagagactcgtctcaaaaaaataaataaataaaataaaataaaataaaataagtttctgttgtttataaattatcaggtctcaggtgttttgttctatcagcatgttctatcatgcatgtttgctgaatgaacaaatgaattaatgagtgaatgaataaactcctttcttccctcatgatcaccttttggctaattcaccacactttaagcacacctgaagcaaagagcaaatactgaaaattgaagaaaatgacatccaaatgcatcaacccagctacctagcagtgctcttacctcagtggtaaagaaatgtaaaataataagtgttttcatttactgaattcctgccaggaatttatatacatcatctctaatccctgtgaaagccctgcatggttgaaattatcatctccatctctctctggggcaggcggagcttggagctctggttccaaggcatggtgagagtctgtggtgttggcaggaacaacggaagcaaaaagacacagaaagacaagtggtttctcttgtggccaatgtctagaatagcagtaatgaagacctccactctccccaaagaacaaatacagtccttagactctaggaaagtaaggtctcctctccaaggggtgtcccctgtgcggggagcatcagtcatggaaatgggtgtgcctagcagggcaaccatctcgtgatccatgatagtcagtagcagcagacagcattgtagcagtaaggtgaaaagtcagagaggaagaaccagataaatccccagaaataattggggacacctcaagcgaggctagtgtctggccagtaagcactgatacataattatgtggataacacaaataagataacctcaatgcataataatgggctaatgggcctgggacacacacattgtcccccaatatcattttcaaataattagactacaataaaataaacaatgttaaaattgtagtgggcataatttagaatatacttaccgtctcaaggtcatgattctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacatatgtgaaatctgcatgattttacacataagtgaaatctgcatgattttacacatatgtgaaatctgcatgattttacacatatgtgaaatctgcatgattttacacatatgtgaaatctgcatgattttacacatatgtgaaatctgcatgattttacacataagtgaaatctgcatgattttacacatatgtgaaatctgcatgattttacacatatgtaaaaatataattttatactactagatattataggacacatatatagatataattttaaaatactagatattatagtacatatatgtaaaaatataattttacaatactagatatagaaccaaatggtaccttagagatgaacacagtcctggaagtttagtaacttgctggttctttaaataacaagcagtgtgtccttgaacaggttatttcatataagtagcaagttgctcacttgtgaaatgagcacgttggactgggtgatcttgaagcctcctctcacaggcataatgctttgaacctgtgagcccaccactccagtccagcagcatctcttctcctgtctctccctattttatagatgagaaatacaaagacagtaaatgatcataattgtcaaacggaccgaaagttgagtgttctgatttttttccactcatgtccagtccttcatgggccttctgattttccagaagctgccactgtgctcaacccaccagatcttccctgtctcaaatgcattaggccaccaaatcaccctcaaaccaaagttttcgctctcaaaatagttgagataggctgggtgcagtggctcgtgcctgtaatcccagagacttaggaggctaaggcaagaggatcgcttgagcccaggagtttgaggctgcagtatactgtgaatgcaccactgcactccagcctgggcgacagaatgagatcccatagctgaaaaaaaaaattaaattaaaagttattaagataaatcattatctcagataagaaataattcactcacggtaaggtatgaatgaccttattaaaccatgtgaactccagcagatggaatgtctgatatatctaacctattattaacatccaccctcccctccccacacaagaaaacaaaaagcaatcctttggcatccaatttcagctgatccctgctggaagttattttgataatactagggctactgggaagtgacctctttgaacgaataccagatttgttatctgtttctgcatcatcttctccagtaaacacgagtacctggaggaaagcatttatgtcttactcatttttgggttccctgtgtctaatatggtacatagcacatgatggggcctcaacaaatgctaggtggattaataaataaactcaagtagaaaaaaaaattaaccttacccattggaggggaatccataaaatgtttggtataataaaaatgaggagcaaccgggcgcggtggctcatgcctgcaatcccagccctgtgcggggctgaggcgggtagttcacgaggtcaagagatcaagaccatcctggccaacatggtgaaaccccgtctctactaaaaatacaaaaattagttgtggtggcgcacgctactcaggaggctgaggcaggagaatcgcttgaacccaggaggcggaggttgcagtgagccaagatcgcgcaactgcactccagcctggcgacagagtgatactctgtcaaaaaaaaaaaaaaaaaaaggaaaagaaaaaagaggagcacatttcttttttgcataaaaaagtcatagtctggtgaagatggggattatggttataaaataataataggctgtggtggctcatgcctgtaattccagcactttgggaggctgaggcaggcagatcacttgaggccagcagttcgaaaaaattagccgggcatggtggtgggtgcctgtaatccccgctactcgggaggctgaggctagagaatctcttgaacccaggaggcggacgttactgtgagctgggatcatgccattgcactccagcctaggtgacagagggagactccgtctcaaaataaataaataagtaaataaatacataaataaaaataaaaaataatcgggggatggcagggagcaggggagagcattagggaaaagagctaatggatgcagggcttaatacctaggtgatgggttgataggagcagcaaaccactgtggcacatgtttacctatgtaacaaacctgtacatcctccacgtgaaccctggaactgaaaaaaataaaataaaataatgatttttaaaaatcaccaacatgtagagacgtaaataggaaaaaaaaatgatcaatgacaactactgagtgtgcaccatgtgccaggaaccacgttaagccttttctgggattacttcttttaattctcacaacagtattatcaggtagaaactatttttactcctattttatagaggaagaaactgaggccaaaaaatgctaagtaactcttgcacagtcaggaggagagagggtccatgcaacttgattgcagggcccatgtctgtaatttggttttctgcaggcaagcacgcagagagatgggggagagccatgtgtcctgtctgggtcacaatacctagagatacctccttgatccagcacaaacaaaacggtttccacaggacaataatgttatatttagttgcaaaacaaacaaacaaaaaaaggtctaggtaaactggttaccaaaagaggaagaattaaacaagtgtgaaaagctagtctctactgaaaagagatttttatcgtcaagtcagcaggactaggagaggactcagacaaaccactaaatccacaagtcggacaaaaaagggcttgtcatctagagttgtattaagtagataactttttatcctttgcatattgccatttggaggagacatactctgcttactaattatggagcgttaaagactccagtctgtaaatattcagctctaaagtcattcctggaaaacaaggtaacgggaggcaggagacacctgaaagtagccatccaaaagactggttcattagtttgattgtaaacattctcctctgtccctactatttgaggaatttatgattccctaggttggaaaatacctagagaactgaaatgtgcagtaacaatgcttttttttttttttttttttgagacggagtttccttttttttgcccaggctggagtgcaatggtgtgatctcagctcactgcaacctccgcctcccgggttcaagtgattctcctgcatcagcctcccaagtagctggaattacaggcatgtgccaccacgcccagctaattttgtattttcagtagagacaaggtttcaccaggctggtctcaaactcttgacctcaggtgatctgcctgccttggcctcccaaagtgctggaattacaggcgtgagctatcgcacccagcatttttttttttttttgagacaacggctcgttctgttgcccaggtgggagtgcagtggcgcaatctcagctcactgcaacctccgcctcccaggttcaagcaattctcatgcctcagcctcccgagtagctgggattacaggtgtgtgccatcatgcctggctaatttttgtatttttagtagagatggggtttcgccgtgttggccaggctggtctcaaactcctagcttcaggtgatctgcccgcctcggtctcccaaaatgaacaatacagttctgggcacactgtttcccccctatttcaaatttctatgtcccttataatcaacattgccaatacattaataatccttagtgaatggccaatagaaattttctaaaagaaatttttcttacctaacttgtatgagtcttttaacttttaggtctatttccctttaaatcctgcagtttaaataactttgctttggccaggtgcggtggctcaggcctgtaatcccagcacgttaagaggccaaggcgggtggatcatgaggtcaggagttcaagaccagcctggcgaagatggtgaaaccttatctatactaaaaatacaaaaattagctgggcatggtggcaggtgcctgtaatcccagctactcgggaggctgaggcagagaattgcttaaacccgggaggcggaggtttcagtgcaccaagatcgtgccactgcactccagcctgggcgacagagcgagactctgtctcaaaaaacagaaaagaaaagtaactttgctttggataaaatgtgttttttcctccaactacactttcacattttctctctttgatacgcagatgttctatccatgagatcatagtagcttaagcatttatagacaaggcagtgtgatgtcctatagttatgctctccagtacagctgccactagctacatgtggctatttaactttaaatttaaattaatgaaaattaaatgtaactaaaaattaagtttctagggccagcacagtggctcatgcctataatcccagcattttgggaggcctaagcagggaatctcttgagaccaggagtttgagaccagcctgggcaatattatgagacccccgtctctacaaaaattcttttaaaaatttcttttaaatttttaaatttaagccactcctagctactcagaaggctgaggtgggaggattgctcgagcccaggagttcaaggctgcagtgagctatgattgtgccactgcactgcaccctgggcaacagagagcaagacctgtctcaaaaaaaaaaaaattgagtttttcttcacactagtttcattttatgtgcgcaatagtcaccatattgtggggactgtattggtaacagagatatagaaccttatcacagaaaattctgtggctaccccagaaagaacacaacacacgtttagcaacagacagaccttcatcttttcaatttccaccttaatcttttactagacttgtgaccatgggaagtttcttaaactttcaaagtttcagatatttaaactataaaatagaaatacagctgggtgcagtggctcatgcctgtaatctcagcactttgggaggccaaggcaggtggatcacctgaggtcaggagttcgagaccagcctggccaatatggtgaaacctcatctctactaaaaatacaaaaaattagccgggcatggtggcaggtgcctgtgatcccagctactcaggaggctgaggcaggagaatcgcttgaacacgggaggcagcggttgcggtaagccaagatcacatcactgcactccagcctgggtgacagaatgagactctgtctcaaaaaaaaaaaaaaaaaagaaagaaaagaaaagaaaaaaaaagaaaaagaaaaaagaaagaaacacaaacatacctacacctgtgtggtggtagtcagtaatgcccaacacactttattgcttaataaaactattattattagtgcttagggatcaaacattccctttttgatccaaagtaaaaaagcttttgaggccaggtgtggtggctcatgcccgtaatcccagcactttgggaggccgaggcaggcggatcacctgaggtcgggagtttgaggccagcctggccaacatggtgaaaccctgtctctacttaaaatacaaaaattagctgtgcgtggtggtgcacccctgtagtctcagctacttgggaggctgaggcatgagaatcgcttgaacctgggaggtggaggttgcagggagtggagctcgtgccattgcactccagcctgggcaacagagcgagactccgtctctccaaaaaaaaaaagaagcttttaagattcaaagtagatatcaatattttcttcataccttgagtactcaataaaccttgcagactaccaaaaatttagattaaaaatgtcatagaatacttacacgtttttgttccttctctaggagaaaaacaacttgaattgccgtggagaaaccttagactctggtagctgtttaaactcataaattgtcccagaagatttctaattcccaaaccatcaaaccgtccctcacatttaattcaggaacacgttcggcaaatgtttgtgtttgtacacgaagtctctcagcgatctaagtttgacttggagagcaatgaggcaaaattcccatcttcctaccccactttaacttggagataaaacctactcaagttatacataccagtactttcaaaagcccttcaacttatctaagcatctctctagccccacactcttccccttttcatctcaatatggaactttgtgtaaaagcatccaaagctgaaagacagagctgtggattatgtgcctgcagagcttaatccctgccaatctcacagaggggcaccttacagttaggaatgtgtgcaaccagagccaggataagttcagactcatcaaacgattgttttatcaaccacaattacacaatacaactaaaacaaaaataaccttgagaagcaatgagtaacctacaactcatcatgatatgaagttcaaataattgctaatgccacacttggacagtcaagtttttcaagcttccccctgctccccctgcccccaaaaatagacaagattatgcaatgagaagataaaggagatagaagacaatgctccagggccaggcgtggtggctcacacctgtaatcccagcacttagggaggcagaggcagttggatcacgaggtcaggagttcaagaccagcctggccaagatggtgaaagcctgtctctactaaaaataaaaaaaaaattagccaggcatggtggtgggcgcctgtaatcccagctaattgggaggctgagacagagaattgcttgaacccgggaggtagaggttgcagtgagctgagatcgcactactgcactccagcgtgggcggcagagtaagactccatctcaaaaaaaaaaaaagaaagaaaaaaagaaatcaatgcttcatccttattattcaaagctagattgcaaaatatactaatctaagaaatctttagtttttctcctccctatagctttagttgagctttatgtagggtttctttcttttatacaaagaagcacaaatatctctcttggaagactacagctcagtaactgatgggaacatgcaagggcaggtgaaaacacacaggacaacaatataagaatgttttctgatgcacaatatgagcaaatacggttctagtcactctctttctgctaagcaaaaaatctgacccaagccaacccctgctatctaaaatggtcatttttgaaaaatgtctttattagtaatcatttgttttctgtagaaatgggaataataatagctagcattcattgagcatttaatatgtttaaagcactattttaagtaattcgcatgtattaacaacagccctatgtggtaggtagagaatatcatctttcgttttacagaggaatacaccgaggcatggagaggttaaacaatttgcccagggtcacccagctaataagtattagagccagaatctgagcttgggcaatccggctccattttacactcttgtctctgttggcagttgaaacaaagatgcacttacatggacattgattccttgctacacacaaacctgcaaccatatgtcaagactaacatcttatagtttatggttacttgtagaaaccaaattaaatgaggaacccaaacatttgattggaacctattactgtcatcaaaacccacttctccttggttttcataattcccagtgggaagtgtatctcagcaattttgtctgtcaggaattttgaaaagtcaagaggtgagtcctagtgacattacttcagctccaaatcatagcacacctgaagttggagccatccatgaatttttcttctttttagttatgtggctaaataaattccctttttaaaatggctgtttgagtttcaactgaaagactcataacagatacacccccttctccagccactgccatccccacccgcacagtgagtgtctcacaggtgggaccatgacctcagccggtctgtttattcagagtgaacctcagggcttttgtagacatggccagaaaagaagctctctttccattggacttgaacctggaaagacgtgagcctggaaatacggcatcatctaaggctgctggagtctgctgcacagagctggggtaatagcccatcgagggtgaaagtggagttaagagaagcagggacattgaaccctgcaggcatcatttgagtcctgaactttttagtgtcggaagccactcaacctccagctatctattcctgccttacaaagaccctaaatgtagtggcttaaaacaacaaaaatttatgatgtctctcagcttggcaatctgagtgattgtctggatttactagtcagctttaccacagtaacaaatgacttcctaaatcccaggggcttgtaacaacccatgttcctcactctgccgttacacgtctgcgatcacatcagtgaaggctctgattctgctccatgtgttttcacgttcggggaccaaggctgcaggaggagcccccattcaagcaagacctgtcatccccttggcagaatgaaaagagcaaaatacccgatggccctttaaagcctcagttcaaatacggtgtatgttatgtcctttgataccccattgaccaaagcaaatccctgactttgaggactccctgtagctgtctgggtaaattaggttagcacccgaggccctttgtgagagtttaaaataaggagatatgcacatacagagaaaaagagagaccgaggcaaagaaagagaatttatgtgtatttctacatgcatggtgtgtgtatgactttttttttttttttgagatggagtttcgctcttgttgcccaggctggagtgcaatggcatgatctcagctcactgcaacctccacctctcgggttcaagtgattctcctgcctcagccttccaagtagctgggcttacaggcgcccatgaccacgcacagctaattttctgtatttttagtagagacggggttttactatgttggccaggctggtctcgaactcctgacctcaggtccacctgcctcggcctcccaaagtgctgggattacaggcatgagccactgcacccggctggtgtataacgttcttaaggcaacttcatttctgtgtggaaggttgaaggtcagtcccaacctgagatataggaccagttcttttctagtcagggagaattcaggaagccacgttccaaaacagtaagtcagacttctgttgagcctgctctgatttcagaccttcgttctgctaacagggatccagcctttggccccatctgtagagtcacagcagctctgctgctgctcatccgctggggctactgccaattgctgctcagtcccttgctgtcttcatagagccttggtcacaagcttcttctcgaggacaactacagggtctgccccaggtacatccccacccatgagcatctagtttccacctcctttctgcctaccagtcaggagctaagataattctgataatatagtaataatagcatctgtcatttattgcatatagtaataatagcatctaccatttattgcatatagtctcaaattcttatgtatcccagaagtgcagctatttccagctgggcctctgttttcattaggcatcattcttaatatagatctcaacccttcttcaagtcccccagaacaatccatgaacaccaaaagtgttcacgagccatgtgtaattgactgaggcttccccaaaacagtggagtagagatttatagggcacacccaacagaagcagcttttctctaatttccttttctgctgtgctaccatcaaggctcctccttctccccacatctcgaagcttagccttctcagtcgtatgctgaatgcatactgaagtaacagataatggaatatgtaactacataaagcttaaataatagggtttattatctctgggggtatcattttcaggctttgttaattcagggacccaacaacatcatcaagcactcaacccatgtgttttctacttccctctgtgccatccccagcctgttggttttcatcctcagagtttccctcatggtcacaagaaggctgccacagctccaggaattacgtccacacataactatatctaaagataggaagaggaccattattcctcctccccacatcataaaggaaaaactttcacagaaacatctcagaagacttacctttaaactcctccactggggttgggttacatgctcatgccctaataataaaagttattcagctgagacaggagaatcgcttgaacccaggaggtggaggttgcagtgagctgagattgcgccactgcatccagcctgggcggcagtgcatgactccttctcaaaaaaaaaaagttattcaggttgagtatcccaaaatgcttgggaccagaagtgtttcagaattcagatttttttccctcccgattttgaaatatttgcattatacttaccagttgagcatccctaatccaaaaacccaaaacctgaatgttctgatgagcatttcctttgagcaccatgttgacactcaaaaaatgttggattttgaggcatttcggatttcagattttgagattaagggatgttcaacctttattgacatttttagcctctggagttggaaagtggattctgacagcaaggatgaaagatgaggagagaatggctgttgggaagaaaaccaccagactcacccaccctgagtagcttggtgtcctactcacctgtgtgctctgcaaagtacaacgcccaactatgactaggccatgctcttgaagcctgggtaagagccatctaacattactcaggaaggcctttagagtccgacctctgccccaaccctagcaaggttattaaagccagggatatcaaaactccttccttagaggagttttactcatctttatacctttactgcttctccacatgcacagcaattctgcagtctgagaattatctcattttttcagatatggaagctgagtagcagagaatttaagtgactcactcagagtcagataactactaaatggtagatcaatatttgaacccagggctctctggttccaatgtccttgctgtcactgaaagcagaacaaagacccaaaagaaaaagcaaagaagacagactaggcttaaattttagcagaagagtaaatatcttcttggtcctttagtaacttaaaaccattacaagtttctacagaggaatgtaatttctgtccttggttatctggaaaagataaaacagagccgtgctttcagtacttggccgaggacatgggggcattttaaagtgttggaatgattgaacacaagccatgctgctgagtcctggacacccaaccctttaaatgaggcctggggagacatttactgaggatctggcccctgccccaagaaagggggtcccaggccaaaaagctgagtaaacagatatttttgccacagtgtggtaagtgctattatggaactatgaacaggtctgtgagagtgtgggtgggggagaggggcggggagggtggacggtagaaaaacccctgactgaggtcatccctgtgttccaggacagtgcagtcactcattgcaaaacagggaccctgagtcatgaggaaagagctaaagtaaattcagtagacaccattaaacaaggcaggggatgggagatgtcttggaacgatttccttccaatatggtttacaggaaaacattttagcaattctgaatgtaaatttcaggggtttgtttgtttgtttttaagcttactttatggagcattacacatggctttatgaggattagttcttacttcatgtaatatagtaagtaatttgcatacactatctcatttaaagcttaaaataatcctgtgaagttgatagttctattttcccactcaaaaaattttttttttattttcggtgtggagtggtaactcatgcctataattccagcactatgggaggccgtcaaggaaagatcgcttgagtccaggagtttgaaccaacttgggcaccatagtgagaccccatccctataaaaaatactaaataaaaaattaaatttttttcaaaaattttagttgcttcccccaacacagtgcacactattttaggtacagcaattgatcagagaggcaagacagcttgtccagggtctgtcagttcttcattggcagagttggaatcagaccctccctgtcatgaggccaaggtgccttctgaaaaattcactcccagcaaacacatgatttcctgggagaggtggttatagcttagtatactggatccagatagaaaataggtgttctgtgctcacagtggaaaagcaacaaaaatggtaatgaaggttgaatgatcatcagtagaaagaaactttttttaaaaaatggataatggacaatgctctatcctcatatatttctgtaacaaagaattaaggaattcaaagttttaaggagaaaagtttgtcaccctgtattttctatagcttgggcaaattgacagacgtgctacaaaatggaagcagttaaacaacatccaatccagaccattgccactcagagttcctcatcccctggttgcttgttagaaatgcagattcttgggccccttccaggcctactgaatcaattgaacaggaaccccagttgatttgcatgcacattaaatctgaggggcttgctgctctacatagatacctttctctgccattgtttcgtccattgcagataatgtcttacgagtctatgaaaatcaaacacatgagcaggtcatgttgtgagctgcagaagacaaatttgacaacaaagcaacatttgctatcttttttaactaagtttaattttaacttaatctagtaacttcttttgaataggtttttgggaggatttgtggtcctacaagaggagagggaagataatggggaaaaagaagtcagcaggaaggaaaaggagggtattttccccaatggcgcagaccaatcatatgacacccttaatgtgttatcaaatttctacaggggtcagatgtgaagcccattacctgacatgcccgctgggtggtctggactttgaacaatggctcctcccatctggaaccctctgctattttgcaaacgtttcaatggctctgctgaaagccaggaaacaacagctggtgaataatctcattttatattaatagagcagcactgacctatccaggtcccttaatacttcacgaaacagaacatcctttctttcccagggcaaggaagggaagtctcagccataccacattacagcatgagtaggggccctgaagaagaatgaacagaaagagttttttcttgcaaacccacctcactggactttttcagatgaggattaagttaagctaaaggagatggaagagaatatctgcattaaatccctggactttacctatgcaaagaaataaccagaaagtaagaagattcttgccccagccttgcctctgtcttctgtatgtgcagctctttctgtgaaatcaaggtagagatgtccaagttaagtgacaatctgaaagataaatatggactatttttaataccagggctagctggtggattaatgttagtggagtcaaataaaacagaatgtgacaacaccaccagttaatgagtgtttgtgtctgtgccggtagcatttttaacgctgtagagaattgcaaaggaataaggtataatctgtgatttcaaggaacttcattttgctggaggatttcttcaacacaaatgactagaagcaaggatgtaaaatataaactgaaagatacatatcttagccaattataccatcactgacacatacagaaaaggaagattaaaatgttttgattaagcaacatttctagagattctgtcaaaacttaaacaaacaaacaaaaaatcctggaaaacagtaatcctttctttaacatttacaaaagttcaattgggtattcctgctccaattttctcagtgtggaatagatggaaagttgctagaagggagtggttacatgccaccagagtaagcaagctggaccaggcatagaaactagctgatgagaggtagggagaatggcagaaacttcttaaaacagtagttcctaacctttgccttttgtctgggtcaaggactctgtgatggttaattttatgtctcactttggctaagtgatagtgcccagatgtatatggtcaaaccttattgtggacatttctgtgagggtgtttttgggtgagactaacttttcaattggtggactctgagtatagcagatggccctccctgatatgggtgggtctcattgactccactgagggcctgaaaagaacaaaagactgactccccctgagcaagaggggattctctggcctgacgaccttcagaccttaactgaagccttggctcctcctggtctccagcctgccagcccaccctgcaggtttgagacttgccagcctccacagtcatgagccaattctttaaaataaatctctttatagacacatcctattagttctgtttctctggagaacactgactaacacagacccttttgtgagtttttagaaggaatatttattgaatgtcttctatgtgcctaattatggactctgatcccagaaaattgcacatgaacacaaaattttacttacggtttccagggaatcaccaaacccttgaagcacatccatggactccctcccttcatttaaaaactcctgggcctccagccttttatataaaggagacgtggctgaatatttccccatccaaatattcctgctctgaaagcagttaccacctggtgggtgaagtaaggagtctacctgcccacagctacaaaaggaccaggaaggcgtccggccacataactctctctccctcacctctctgggaggccaggaatttctacgttagcatcagcactctggggtggacgtttgttcacttaactagaataaggcattgttactacccatggtatggctgagcctagctggttgttcttaagcttaaacatcagcactgccttccttgacattctccttatctcctcgtccttgctgatggactgtgagtgaaggtgatgtgtgtcacctccagtcagaggccatgcagatggggatgcctttcatgacctttccccgctttcaccagactcagtgaaggacttctctgaggtattgacagaggcctcagatggccaaggggccagatcctctttctcctgcactccacactggattgtgacacaagcaaaagatcatcctttatttatgttacttatgttaaatgactgagatctggaccttgtttgttagcttatcctgactaatgcatacaggaattttaccattatgagaaagacagtaaaaatattagacaaataccaacttaaaaattctaatatgatctaggctgggtgcagtggctcacgcctgtaatcccaggactttgggaggccaaggcgggtggatcacgaggtcaggagttcgagaccagcctggccaacatgctgaaagcccgtttctactaaaaatacaaaaaattagccgggcatggtagcacgcacctgtactcccagctaatcgggaggctaaggcaggagaatcacttgaacccaggaggcggaggttgcagtgagccaagatcgcaccactgcactccagcctgggtgacagagcaagactctgtctcaaaaaaaaaaaaaagattctaatatgacctaagccattattacccattgaccttagcagagactaaagcctgggtcctgaggaagtagctatgtttaggactaagaactccaaactcagagaccgcaggagaagactaggcttctgctggaggcagtcatgctgcacaagtccaggaggctccattcacccagattctgtagttccctggagttgtacagtgcactgcctgcacaactgtacaaagtagccctgctactggtagtggcaaagcagcacaaaagaggcaggaagaaataaaagagagagaggaagggtgacatgggagcctgctatgcctctctcatgacctcatcacccagtcaagtgctggccctgctcattgctgagatacctgaaaagtccacccacacctcagctaatcagattctaggaccagccttggtttgggggcctttttgtctatgaaaagaagcatatctcccctgaactagttcttgagggtctaccttaaattattggttactaaaggaaaaatagtacaaagggtaacctgtatgttggccctgcagttagaaaatagggattattattcccatttgtcacagaaaacctttctttcttctttctttctttttttctttctttccttccttccttccttcttccattcctttcctttcctttcctttcctttcctttcctttcctttcctttcctttccttctctctttctttctttctttcttttttttgacagagtctggccttgtcgcccaggctgaagtgcagtggtgcgatcttggctcactgcaacctccacctcccgggttcaagagattctcttgcctcagcctcccgaatagctgggattacaggtgcctgccaccacactcggctaattttttttttttttttgtatttttggtagagacggggttaaatcatgttgcccaggctaatctcgaactcctgagcttaagtgatccgcccacctcagcctcccaaagtgctgggattacaggcgtgagccaccatgcccagccaccctcacacccacttttaaaacactttatattatagaacacttcaaagatatacaaaataggtaaaataatgtaatggaccatcattaggcttcaacaattatcaacgtgtggaaattccatttcatctatttctctctaacccttattctctcccctattttctaccacttttctggattattttgagatgcatcccagacttcatatcatttcattcatacatattttagtatgtagctccaaaaaaaaaaggattctgtttttttaaaaagcataaccatgacgtccttatcacacctaagaaacttcgttaatattgacaaatattcagagttcaaatgtctccaattttctcataatttttttctacaatttgtttaaattagtattcaaacatgattcacacctgcagttggctaatatgtctactggctctcttttcagtaacaagctgccctgtcttcttttcttttcttttcttttttttcttccaatttatttgttggagaaactgggccatttgtcctgttgagtttcccacattctgaattttgctgattgcatccctgtggtgtcattccacctgtttccctaagccctgtatttcctgaaaagtgtctgctagatctacagccttgaacaattccagcttgatattttgacaaggttatttcataggtggtgttgcgagcttttgcatctcatcaggggcacatgtctgcttccctcccatttttgtaatgttaagattaattagaggattcgggtattgccagcttagtccatccattagagagttccccatcagcatttcccctaatagttttaacagccattgatgaccagtgcttggatacattatttctatgattgcaaaattatggtattctaattctatcattcctccttcatctattagctgaaatgcttctaaaagaagacctttccctcaacaacaatttagttaccctgaaatacagttcatatacaaaagacaaatgctcaattctttccctttttaaatcagttttcagagtaatgagttggttccctagcaacccgtaaaggtgacctatgagaattttttttctggtataattataaactcatggattttaacatatttgatgtatttcaatccagtgtggatgcttgaattattccatctttgaacagtgagtttctttctattggttcctaacctaagcatttaggacacaaccaagtcatctctgaaagcttcgttactttccagcatgtcaaaatgtctatttcttttcttttctttctttttgagagagagagacagagagtctccctctgtcatccaggctggagtgcagtgacacaatctcagctcactgcaacctccgcctcctgggcagaagcaatcctcctgccttagcctcccaagtagctgggactataggcacttaccaccatgcccagctaatttttgcagttcttttttttttttttttgagacggagtctccctctgttgcccaggctggagtgcagtggtgcagtctcggctcactgcaagcttgggctcactgcaagctccgcctcccagtttcacaccattctcctgcctcagcctcccgagtagctgggactacaggcgcccaccaccatgaccggctaatttttttgtatttttagtagaaacggggtttcacggtgttagccaggatggtctcaatctcctgacctcgtgatccgcccgcctcggcctcccagtgcagttctttttttgtagagacagggtttcgccacgtttcccaggccggtctcaaactctggggctcaagcaatccgcctaccttagcctcccagtgttttgattatgggcgtgagccaccaggcccggcccaaaatgtccgtttcttgcctcagctctggaatcagtgattatccaaggacgccctggttccctttagtgacaaattggatttagaaaccacagtcacagagctggccacctccctacctaggagccctctccctcaggtccctcacatcttcatttgatcctactttttttccccaatccttgactgtcccagcttttccacaagggaacaaaagattaatagctaaaggaaactcatgatatagtcatgtgtcacctaataacagagatgtgttctgagatatgcatcattaggagttttcgtcattgtatgaaccccgtcatgttctcacacaaacctagattgtacagcatgctgcatgcctaggctaatgctataacctatccctcctaggtcacaaacctgtacagcatattactgtactgaatattgtaggcaattgtagcacaatcgtacgtgtatgtctatctaaacatatctaaatatagaaaaggtggctgggtgcagtggctcatgcctgtaatcccagcactttgggaggccgagacgggcggatcacaaggtcaagaaatcaagaccagcctggccaacatggtgaaacccgtctctactaaaaatacaaaaattagctgggcgtgatggcatgcgcctgtagtcccagctactagggaggctgaggcaggaggatcacttgaacccaggaggcagaggttgcagtgagctgagattgcaccactgcactccagcctgggtaacaagagcaaaattccgaaaaaaaaattaatttaaaaaaccgaaagaaagaaaaggtacggtaaaaattcagtgttataatttcatgagatcactctcctatatgcggtccatcattgactgaaatgtctttatgaggtgcacgactgtaactgaaaacagttatcaccttgatacaggtgaagattgagacaaatctcttctttagtggaacgtgtctaattccctcacatgaatagcctacactctttcccttggttataagggctccaaaactactgagtccccaaaaccaaggaggtagggggttgagggacatttacctttgcctaatgaaggtttttttttttttttgagacggagtcttgctctgtcgcccaggctagagtgcagtggcgcgatcttggctcactgcaagctctgcctcccgggttcatgccattctcctgcctcagcctcccaagtagctgggattacaggctcccgccaccatgcctggctaattttttaaatatttttagtagagacggggtttcaccgtgttagccaggatggtctcggtctcctgaccacgtgatctgcccgccttggcctcccaaagtgctgggattacaggcgtgagccactgcgcccggcctgaagttttatatataatacaaggagagcgcatcctttctctacaggtgtcttttgcactctggtaatcaaacagttgtttgattgtatggtttctcatcaagcatttttacccttcaagttttatctataagtctagtgtaagactgggggatatttctaagttgtggtttgatgagtccctgacttcaaacccaactggtacatcacaaaataacaatgctctgtagtcaccaaaatctttagatctacctgaatggatgtggacctatctcctagatagattaggtggaaaacagtatttattacattatcatttgtgtaaaagggaaaaagagcttgaatatgcacagaacatgtttgaatctataacagattggtatagagatagaaaggagactcacatttcaccatataccttttggttgtagttttggcattttaataatgtgcacgaatcatctattcaaaaaatttattttaaaaaacctgaagaaagcactttagtagagaatcaatactgtctgattgattgattgatcggcctcagctttccaaggagttattgtagatggaaagtgaagaagggtatgcttttacaggagtatatttatgtcttagggaaggcttgaaagccagaggggatgacgataaagagagtttgaacagatacccagaaacaactgcacttgaaagaacttgtgaaatgcttaagttctctgacacttagagaattataccctagctgtgataccattatgagatgtgagagtgtgcttgtttagaaagcaccggaacttgacttcaggttctggagccagccaaagagtctcctctctctgtctggaagggttgtgtcaaattcatgcacattctcaacaatgactgtctttttctaatgggggatggggagaaagggcaaatattcaaagccaggcaaaggtgggggcggagtcaggaggcttttggactttgacaccttatctctgtttttgccatcttactggggagtggggaacagagaagagcttggtttattctcagggaaatgtctggagactgccccatggcctcaggtcaccctgaatttaggatttagttctaataaaattttattctgggatgcaacctccctctagttgttaagacttctggttgtccagtctagaatccatatgaaagccaagcttaccatattaaagccaagcttaccaatgacttccaataaaaagagcttagaatggaagaaaagagataaagagaaaaagagaaagatgatctttagttaaagccaaatcactgatcacttatggcaggcccttcactttatctctcctttcatccaccttccctatcaacagcacttctagtgaggtggcattttggagtgggaaagacctaggtttgaatcccagctctgccatattagtggaataacctcgggcaaattacataaatgctctgaaccaatgtcctctttggtaatgtgggacactggtggctactttagtcttaagttaggatcaagtgagagcatttatacaatacaataagcattttttgagtgcctatcatgtgatagtgagatagaagaccagcagaacttgctttctggtcacaatcccgctgaccaaaacagaatctagtccagacaagataaagtgaagagcctggccaaaaccagcagatggtgacaaaagcaatccctagctgccctcattgctcattagcataagacactcccaccagtgccgtgacaagttacaaatgccatgccaacaaccccgaagttaccacccttttctctggcaatgccccagaagtcactgactctttcctagaaagctttaaataacccacccctcaatttgcattaaccctccccttaatttttcaaatagttgaaagtgaatataagtgagtataagtacagttgctgacagcccataccttgctgattctaggcgcactgcctgtgagttagccctgctccacaagaagcagtactgttcaggaaaaggttgctgtctaaaaccactggcttgcccttgaattctttcctgggcaaagccaagaacccttctgggctaagcctcaatcttggggctcacctgttctgcatcatctggtggccacaaagggatgaagatagtgagtgggaggaagtgaccaatgtggcgtcgagacagcagaaatggcagtcatcagcggcaagatggcaagacaatagcaattagcaaagaggccaaatgataagaaatacttgagagatggagaaatggtgagacagcaagatggcaagacagtgaccagtgagatggtgagaggcggcaatcagagagaggtggtgatgtggcagtcagtcagtgctgtaaggatcaaagctgcagagagctggaacactaaccaaaggttcttttcaggaccatcatctttcctggcagatggttgagctgagtggataggtgagtagccatagtgcagggattcaaagctctggctgggaggctgcaggatcacatgccaattccctcgcagcaaccaagcctgcccaagccggggaaacctggggagcaaaccttcacctgcactgtacatcagagaccagttggccctattttggctcctgtggacaggtaagtatcccttttgactcatcccccaaatatcaggtgagccaggaaaataaggcctttggcttagacagtcaattcaaagtctgccatagcatccctaattacatccctattgccccttttctaggtcgtttctcctctaacacgattttatttttctgtcagccattttattttatttctcaccttgaaatatatgttttctttgcagtttttgctttggcttcctgctaactctatttgggcaattgtttaaggctgaacacttggttatgagaggtaccctgttgtgttgaccctgggatgccagagtcatgttgttctgtggccccaacttggtctttggccgccccctggatgctctgggatttttggcattgggtgtggggactctcattggccactactcggttactgtgggttttcagcatttggtattgttggccgccccaggcactcccgggtttttggcattggcattcactaggattgtggggtaggagcctacctaaggggaatcttggtcttgccttttctcattttctaccctaaagttatcgtttcccataacagcatttccttttgttattgccactttatttacacttttcccactataacttgcttaatgaaaatacttcttttgtcacatttcattcactttataagccactttcataacacgttgctacctatacttactccttctctgcaggaagtggaaattggaaaggaaaatagaaagggccccgttgctttccctctcactagactcagaagaacttctatgtccagtagaaatcatcgttagacatggagacaatgataagcatacctgaggactcaccgttaggatgcctttcaggctattggagcaaattcaattttggcttaaagaaaaagaaactcatttcctattgcaacaccacttgggtccaatacaaatgagaagaccaagacatttagcctaaacatggttctatgcattataatgctattttacaattaacattaaaaagaaggaaaatgggacgaggtcccttatgtacaggcttttatggccctttactgactcaatgttacttcaaggcaccaggaagccacgcctaagggatcccctcctagctgcttctcttagaaggcctactccctccccagagcctcctcagtctcccaatttggaggggttcctgccagttctctaacacaggactccacccaaggtcatcaggcactcctccctgttattcagctagccccagcctaaaccctctgctgtcggaaaaagtagcccaaccagtatccctagaaatggggctccatatcagcccctgaagtcaaagctgtgtccattgtgggaggtagttgatggagatggggggacacttagaatacacatgccattttctatgtctgatttggctctatgcaaggaaaaattctgccagttttcagagaattcattaaagtttatagaagagtttgttaaattgaccatgttctttagcttggtatgacttgcaagcattgttgcccacttgctatgccatagagaaaaagcagaggaaagtgtgtggctaagcctctcagttatgaaaaggttagagatgtaattcagggtaaagatgaaaatctcactctttctgggtagtttggtggaggaactcaagaaatatactaatacagactcagactgcctggaagggcaagctctcctgggtaggcattttattattcaatttgctctgacattaggaggaagctacacaaagtagcagtgagacctcaatccgctatgaaccaagccttaaacatggcctttaaaatttataacaatagagacagggcaaaaatggaaaagaccaaaagaaataaccaaaaagaacaattattggtgatgctgtaagcacccttcaacctcagggttacccatccccagaaagtgtctcgacattggtgtctgggatacctagacaagagccccaacttgctagcccccaggacagaatcagtatgcctactataagcaaaagggtaatcagcaataagaatgtcttaatcatccctcctgagatgaaaaagctccctgtccatgttagaactaaccttcttccactagccccaacaagctgccttgctcaagtaagccagagctttgaaaccctgcgctatggctgctcatctatccactcagctccaccatctgccaggaaagatgatggtcctgaaaagaacctttggatcaaatcccggacccttgatccaatggttagcttcccacagtggcagacaagtagccacccaaacattcttcttccgtgtctctgctgctgggtgacctctctagcagctcagggactctgaggtctcccctttagcaatgggctttgccccttcctttccttatttgatgctacaagatccccttccctgcctcttcctgtcttccatacctattggagcaaacgatatttggccaggtagacaggtcccaattttgtaaataacagatccagctgtcttgtataggtcacttcatttgtgtgatgtgtgttgtgtctagcatgctatcaaattggttcataggctgggcacagtggctcaggcctgtaatcccagcattttaggaggctgaggcaggtggattacctcagatcaggagttcgagaccagcctggccaacatggtgaaacctcacctctactaaaagcacggaaattagctgggtgtggtggcgtgcacctgtaatcccagctactctggaggctgaggcaggagaatcacttgaacctgggaggcagaggttccagtgagcagagatcatcccgttgcactccagcctggggaacaagagtgaaactccatctcggaaacaaaaataagacaaaacaaaacaaaacaaaaccaaaacattggcttataaataaaagagcactcataaattaaacaaataggactaaatttgttagtttgaagggaatattgtgacttctaaaatttaactttaagctttttacttagataaaatactaattttcataggctttagaatggttaaaatggctttaaatgttgaactttttgtgtagtttaaaatcttaagattggctgggcatggtggctaacacctgtaatcccagcactttgggaggccaacgcaggcagattgcttgagcaggagtttgagaccagcctgagtaacatgatgaaatcccatctctacaaaaaatacaaaaattagctggatatggtggcatgcacctgtaatcccagatacttgggaggctgacatgggaggatcgcttgagcccaggaagtggagattgcagtgagctgagactgtaccactccaccccagcctgggtgacagtgagaccctgtctcaaaatcaatcaatcaatcaatcaatcaatcaatcaatcaatcttaaaattatagagtggttctcatctatagaatgtcaatatctgatagttcaggattctttgctttctaaatttatatataatgtaccagggaagatatatattctttattgtgaaaaagaataacttgttcaattcagaaattattaaaagggaggttcaaaatataaaggaatctgcgaataaaaaagagagatatgtggtgagttatggatagaagactttttttttttggtggggtggaatatatatatttttaaatgatcttgtgtaacgagaaatcttgtgtggtagattcttgtactagaataaagtcactggtgtttgggagggaggtgacgtaggatgggtcagagggtccagacatgtcatggacggtctgtgtgggctgtgaggggctcatgaaggggaatttgtgaggggagttaagtgtttgactaagctggctatgattgatgggaaattgtttgtggtagactttctagaaaatgatctatgtgccaagcgcagtggctgacacctgtaatgccagtactttgggaggccaaggtgggcagatcacctgaggtcaggagttccagaccagcctggccaatatggtgaaaccccgtatctactaaaaacacaaaaattagctgggcgtggtggtgtgagcctgtaatcccagctactcgggagactgaggaggagaatcgcttgaaccaggaaggcagaggttcgagcagtgagccaagatcgtgccattgcactccagcctgtgtgacaagagtaagactctgtctcaagaaaaggaaaagaaaaaaaaaaaaaaaagcctatgtgttgaaactgggttttctttaggtgttcatttgctaaattaccagaacttttgcttttccattctgtgatatatttcttttgaaagcttttcaaatttgtgtaactctctccttcagctttttcatcagctcctgtgactttttctcctgcagttctgacagttgctgtgatctgatgctaaagtgttttcttagaggtctgcgggaccagtgtttttcctgaatacagcttaattctatgctcgtggttttccttgaatataactttatttttggcttttagtttttgactctctttttcttttctttttttttttttttgagacggagtctcactttgtcaccaggctggagtacagtggcttgatctcggctcactgcaatctctgactccctggttcaagcaattctcctgcctcagcctcccgagtagctgggattacatgcgcatgccaccacgcccggctaatttttgtatttttagtagagatggggtttcaccatgttgatcaggatggtctcaatctcctgacctcgtgatccacccgcctcggcctcccaaagtgctgggattacaggagtgaaccaccacgcctggccagtttttgactcttatattgcttaaaagggctttgagggctaatgaatacatgcccacctccacttctatctggcctagaatgtttaattggctacaagtcattggactctaagtctgctggccaaagagaatccctccccctgccaaaaaaatggaaaaagtaactcaggccatgacaggaaacagggagtcagctgcctcactatgcctttcccttggaatttaggccaggttcaaaaggtctttaaaaattttgaaaataaagtattggcctttcccacagagaaaaataaatagctcctcggttcaatcagaagacttagtgttactaaaaacttcaaaaaaagatcccctgatcatcagttaaaaccaaaatggaagggccccttcaggtattgataaatactgtcactgctgttaagcttcagagagtcactagctgtgtacacctgtccaggattaaacctgtgtcttatgagttccccatgggcataaaaggagcacaccacaacctacatttatgaacctagaaacttaaggctgttgttttgcaagcacatagataaataacaggatgctgtgggtgggggtaggagcattaatttttctcttcctcctaattgtaattttcttgtttagcctccctcgtaaactttgtatcttctagattccacataaagatgatgccagcacaaggcttccaactcatccggtctttggacctggaaaagaaaaacatcctgccattgggcctcttaggtcaggtatccagagacttttacactgccaatactaggcggggtctatgcccataaaatcagcaagaagtagttacagaagatggaccttcacccctctgcagcccccttaagattaggaggctttggccagacacagtggctcatgcctgtaatcccagcactttgggaggctgaggcaggtggatcaactgaggccaggagttcgagaccagcctggccaagatggcaaaaccccatctctactaaaagtacaaaaatcagccgggtgtagtggtgctcgcctgtaatcccagctacttgggaggctgaggcaggagaattgcttgaacccaggaggcagaggttgcagtgagccgagattgtaccactgcactccagcctgggcaacaagagcaaaactccatctcaaaaaaaaaaaaaaaaaaaaaatcaggaagtgtatctaatttctaagggggaagtgaggtaggagactgataggacttgttttctggtcacaaccctgctgacgaaaataggatctagttcagacaggataatgtgaagaaactggccaaaaccagcagatggcaacaaaagtgctccctacctgccctccttgcttattagtgtgagacactcccactagtgccatgacagtttataaataccatggcaatgacccagaagttaccatccctttccaagaagttctaaataacccatctcattttgcattaacctttccttaatttgcatatacttaaaagtgggcataagtgagtataaatacagtttccaagtgcccatatgttgctgactctgggtgcactgcctatgaattcgccctgctctgcaagaagcagtaccattcaataaaagattgctgtctaacaccaccagctcatctttgaattttttcctgggtgaggtcaataattctccaaggctaagccccagtctaggggctgtttggtggatcattgagcccagcagtttgacaccagcatggaccacatggcgaagccccatctctacaaaaaaaatacaaaaactagccaagtgtggtggtgcatgcctgtagtcccagctacttgggaggctgaggcaggaggatcacctgactacaggagggtcgaagctgcagtgagccatgatcgtgccactgcactccagcctgggcgacggagtgagatgctgtctcaaaaaaaaaaaaaaaaaaaaaagtggccgggcagggtggctcaaacctgtaatcccaggactttgggaggctgaggcgggcagatcacctgaggttagggttcaagaccagcctggccaacatgactaaaccccatctctactaaaagtacaaaaattagccgggcgtggtaacatgtgcctgtaatctcagctattcaggaggttgaggcaggagaattgcttgaacccgggtggtggaggttgcagtgagcctatatcgtttcattgcactccagcctgggcaacaagagcgagactccatctcaaaaacaaacaaaaaaaaaaaaaaaaaaaaaaaaaaaaaaaggaaaagaaaaaaatggataagggaatccttgtgctaaagggtgtcagagacaatctgagaggtaaatgctacgctatggactaacagtaaggggaaaagaagatggtaaatttgcagagaagatcaagtttgatcagtttcctggcctgaaggtaggacaatgacaaaggctcattttaggggcttctggtatacaaaggtgtaggggcactacaaaaaagtcattctgacacttgttgaaatgctataaggaagactttatttaagactattgcaataggagagagagatcaggctcaactctgaacacagcttggacaaatggatacttatagtcaaggagcagagtgacggggttggtgggtgaaaaattactaggaggagacatcaagggtagagagattcttgctaaactgaactagcaggattctcactgaaggaaagccaaggacttagacatcaaaggtggaggatgaggaacttgctcaggtatcagtggtgatcagaccacaaaatggagggaattctccctaaactgacttagcaatattcttgttcatactgggctaggcaggccaaagacaggacaggtgccaaggtcttagtggagtctaagtggagaagaaggctcagaggagcatgagtcaggtttggtcaaggagagggtctttgttggagggggaaattaaatggtgtggaggggaattttagatggttcaacaaggaggcaatgtagtgagtggcagcatgggagaactgaggctggagaagttctcagcccatgctgttgcccctgttttgccccttccctccctctctcccacaggagcagttgactggctgcctcttgctgtggttcctgtgaaaggcggctttagtttggatcttcagtggggtaaggggctcttgttcagaatagaggcttccaaatatgcatgaacggaagtaacacaagcaaaatgcatgggacacagtaggtgtgcaatgcctatgggtcctcttctctttctcccactgctcccttttcagtgatgggcccagaaaagctatagttctataccctgtacacatgctcgtctctcactttgaggaagaacaattcccccaaacacttttaaaaaaacagtaacatctagcaataaattaacaactggcaatgaactgtttcctgcaatttaaattgtttctgaatgcagtgtcattaggtcctggctgtaggctcttagggactgcacacctggaaggctgctgggcagaagtgtcataacccatacccccagctcttccttctctcaagtgtcacaatcgttttgaactatttggaatttccacctattcccccaaattggcagcctctcctgacttttatagcttttgaattttgtacaaagtgcatgtgttaactatttaaatttttatattttcaaaaaacgatgatctctgttacagcagctaaagtggattttccccaccccagtaactcaccacatttccctattttatcttcttagtagtacttgccagcatattgtttttatactgtgcccagtctccctccactaaaccataatctcctccagccaatactctgacttgttctctatgaaatctctaatatctagagtatttattttccttccttttctcttctcttctttcttttttttctgttagtatcttatttagatttgtagattgagatgccttcatacaatgttttagagatttttagtggtttttttcctatagcctgaaagagtttacataacagaaattatctattcataaagcaatgctactcaaaatgtgttctgcaggcactaaagtataaatcaaacatactatttagctcgaatgtactatttagctgagttttgttttttgttttttagcaaagactttgttgatgaaggaagcaatatactgatttatgttccagtgcaagctccttaactttttgcgggctggtagcaaacagttctgtaaccagctgagtagcactgcggtaaagggtaacagaatacagatacaaaaccaccagagactggtgctttttcaactgttagatttaaattgcctttctagtctcttccgtgggcattgatctgtttagattttcttcctttacttggctcaattttgctaagttatattttactagaaagctatcaatttcctctattttcagatacatttctagagttgcacagaatagtttcttttagttctctttatctcttccatatctgttttggatcctcaggagtaaatagaggaacatgcagtaaaaaaagattgagaaaagatgcaaaaagattagagtgcaaccaggaaaggtcagtattattctagtcactggagatgcaaaaatatgcaaattctcgaggggcttcatattttatctcttttaattatcctgaaatagttttattattaattgctttttgaagaagtagatattgcctattaaattatctacttagagactggtcagagtttcatgttctttttttgttacttgttttgtttcaaaattttttatttaattatttttatttttattttacaggtgcccaccaccatgcccagctaatttttgtatttttagtagagacggggtttcaccatattggtcagactggtctcaaactcctgaccaccaggtgatccacccgcctcagcctcccaaagtgctgggattacaggcgtgagccactgcacccagccttcattgttatatgttcattatatcacttataatgtattatgtttataacatataatgtttgtaagtattattgataggtttggctgtgtcctcacccaaatctcatcttgaactgtaggtctcataatttccacatgtcatgggagggagggggactcagtgggaggtaattgaatcacgggggcgggttttcccatgctgttctagtgatagtgaataagtctcataagatctgacggttttacaaagggcagttctcctacacatgctctcttgcctgccaccatgtaagacgtgcctttgcttctccttcaccttccaccatgattgtgaggcctccccagccatgtagaacggtgagattaaacctcctttcttttataaattacccagtctggggtatttcttcatagcagtgtgagaaccgactaatacaattatgttcttgatgttcattcaagtataaaaagtgcatccctttgggttctcatcctatttctgccactgactgctaagtgatcctgggcaagttcctcaggctctctgaaccttataagctgcaagattgagaggttgctctagataacaatagctaaaatttatcaactgcttactgtgtactaaatactgacctaagtgctttacatgaataatttcatttaatctctatgaattaggtactattatttctttcattttacagatgaggaaactgaggcccagaaaacttgctgatgtttcctgaaaaaatagaatctaagtcaatgctcttgggaggtgcaattctagggatgtgggagtgaggggtagggggagtgaggcagggaagatgggaagcaaatgcaaggcgatgagtttccacactggctaccactttactgtgagccatgaagcagcacacctggtctcatggcaggaatggcttcttggccttagggaacactggctgcgtggaaaaaccacacctcagaatgatccatgggagaggaaaggggagagggagtttgctgccatctctcccctgtctcttgtctctactggcccaagtttgtcccatagggagtcgagaatgccttcctcctgggtggtgtcatgcagcctctttagcaggcgctggggaagttagttcccaggccttgtgggttggctgttcatctgagtctggaagtggttggaggagccataaccccagatagggagcaggtgtgtgggccacacacagtagctgaggcaaaacaggcagctgaggaggcagataaggctgagagaagtctgatattcatggatgggtgtggtgagtagtcattgaaatgcagacaactgggctgggcatggtggcccacacctgtaatcccagcactttaggaggccgaggcaagcggatcacttgaggtcaagagttcgcaaccagcctgggcaacatggtgaaacctcatctctactaaaaatgcaaaaattagcctggcatggtggcgtgcgcctgtaatcccactactcaggaggctgaggcaggaaaatcacttgaacccaggaggaggaggctgcagtgagccaagatcaagccactgccctccagcctgggcaacagagcaaggctccatctcaaaaaaaaaaaaaaaaaaaaattgcagacaactggactctagggccagaccactagcaatatgctgcacatctctgagagcccttaggtatagaaaaaatattattattattttttgagacaggatctcactttgttgcccaggcggagtgcagtggtacgatcacagctcactgcagcttcgacctctgggctcaagtggactacaggcatgtaccagcatgcctggctgatctttttaattttttgtagtgatggagtcttgctatattttccagggtggtctcgaactcctgagttcaagcgatcttcctgtctcagccttccaaagtgttggaattacaggtgtgagtcactgtgcctgccagaagaatgtttatggtcaggtacatacaggcccagtccttgttttctcagtgttcaagtcttcaataataatatcccctctgttatcttcctagtgaaatcctattcctttctcaaatcctatttggataacaatttatctccaagcctttaagactcaatcactccattctctcaattgttttggcaccttgtgcatatttctcttcttgcatacatgatatttattgtagcctatattagagcaggctgtatgtttactaacggcaggaaccctattgtgttttcagatcctgtaacccatgtctgcctagagagagcctttggtatgtgcctgcagagctgaatgatagacaattttacatttgtggccaggtgcagtggtttacgcttataatcccagcgctttgggaggctgaggtgggcggatctcctgaggtcaggagtttgagaccaacctggccgacatgacaaaaccccatctctactaaaaatacaaagattagccgggtgttgttgtgggagcctgtaatcccagctactggggaggctgaggtggggagaatcacttgaacccaggaggtggaggttgcggtgagctgaaatcacgtcactgcactcctgcctgagtgacagagcgagactctgtctcaaaaaaaaaaaaaaaattacatttgtgtaggtttaaaaaaaaaagtttaaattttagaacagttttagatttacagaaaaattgcaaagatagcacaaagagttcctatgtgctctgcacccagtgcccgtatgattcgtatctaacattagtatggcacatttggcacaattcataagccaatatttgtacattataattaattaaagtccacactaagtcaggttttcttggtttttacctaatgtcctttcttctgttccaggatcccacactacatttacttgccatgtctcctgagacccctcttggctgtgatggtttctcagactttccttctgtttaatgatcttgatagttttgagtaatgctggttaggcattttgtagggtgttcttcaattgtgatttttctgatgttcttgttctgatttgactggggttgatctggggagtaagaccagatagttaaagtgccactggggtcacatcctatcaagggtacgtactgtcaatatcacttaccatgatgatgttgaccttgatcacctggctgaggtagtgtctgtcaggtttctccactgtaaagttgctcattttccccctttccatattgtaggctttggaagaaagtcactgtgtgcagcccacattttaggaatggtggtttatattctatttcctttagggtggagtatcaacatacattgtttggtattcttctgccctggggattcgtctatcctttcccatgtattcagccatttatttatatcagtatggactcatggatatttgctttatactttgggtcatcatctagtactgcttcattttattttgttttaatttttgagatggagtctcgctctgtcacccacgctggagtgcagtggcacaatctcggctcactgcaacctctgcctcccagggtcaagcgattctcctgcctcaacctcctgagtagctgggactacaggtgcatgccaccatgcctggctaatttttgtatttttagaagagacagggtttcgccatgttggccaggcaggtcttgaactcctgacctcaggtaatccacccatcttggtctcccaaagtgcggggattacaggcgtgagtcactgcacccggcctagtactgctttattttgttgctcaaatgttcccagctctggccattgggagctctgtcagttggtttctgtgtccctttggcataccccaatcattgtgggggggtttgggtttgtttgggttttttaacactttattactttctggcactaaagatgttccaggctcaccttgtgtatttcctgacccagtcctagagtcagccatttctccaataagacttagttccttttcgtgaagaatggtattacaaaccaagagctgggctctaggtgtgtcattaccactggggtgtcattaattccaggccctctcagctgacagagcaggaaaatatatgtgtgtgtaatagtcaggaaggttcctttaatcttacaaagcacactttgaaaaattggaccaatttagagttctctggctgctcagtctcaatctcttttgttttccttttcccagtgcctgttcctttgtgcaagtccagaccggtttgtcctcgcatcccttccttgcccttcctctgctccacggcctcctgcagggagctgatccctgacgtctcctaggttcccaggtcagctggctgctggctggactctggccaggccagcggtgcaccagttggaggtgggggcagcacttccagatgcagctccagggcctgctggacaggccccctgtgattctgccttcttctaggctgtagtgacatcacccctgtcctttgtccctcctgcctggaggtgtcaatgacttctgactggggtctccctgcccctcatgggcttctcaacttcttctgtcacatatgtaaccatttctctgaataaattccctttgtttaaaacagtgctacctacttccccggtgggccttggacagaactgtcggtagggagtttcattaggaagggactccaggaatggcagtggtgtctgagtaaaagcaggatggagggagagtgagtccaaggcagtattctcaagccagtcactgctgtgggccctaggaagccaccccactggggactctgagtcactggggagaacagccctcagcattgtctgacagccccaactgctcgagacgtgcccaaaggtgaggaactccctagtacttccaggttttcacacaaatctgaatggctcaatgggaccccacagggatccccaggccccgatagatgctagagattcgacaggaggctgaggggagggatggatggggtatcagccgaacccactgccacagcaataactgaagtttaaacaaaatgaaaaaggatgggcagggggtgggagacaggcccagaggtgtctgggatgctgagctcccctctgctggggcctttctcatggctctcttttcctctcagtcttcactctttctgagcaatctcttacacaccccggggtttcaacaactatctacatgatatgggaggatcagagtttgctttgtgctttaaaaataaatctattgaagcccctgactggctttacttgcagaaattccctttgcagaaaagagaggcttccagacactttgcctaactaaataagaaaatggacagtttatataataattgaattacattaatgaggtcattctcagcaggtatgtatgacaaggctggggagcaaatgcaaccttctagaaaaaccacagtggtggtcattttaagtgaagaaacacattctttgttttgttttgtttcgtttttgagacaggggtgggtctcactatgttgctcaggctggtctcgagctcctgagctcaagcgatccgcccacctcagcctcccaaaattctgggattacaggcgtgagctgccatgcctggcctaagaaatacatttttttttttttttttttgagatggagtctcactctgtcacccaggctggagtgcagtggcgggacctcggctcactgcaactctcgggttaaagtgattctcctgcctcagccttctgagtagctgggaccacaggcgcctgccagcacgcccggctaattttttgtatttttagtagagacggggtttcaccatgttagccaggatggtctcaatctcctgacctcatgatctgccagcctcggcctcccaaagtgctgtgattacaggcgtgagccaccgtgcccggccaagaaatacattctttaccacaaacatttcaacaaatgcaattttctctaacaaatatgcatagtttcaagattacaagtcaactgtccttggaagagaactattgaaattaaactctatgacaagaaggctttttgcccttctaagtaccagaaacccaactacatgatgtccaactacagaaagagtacagacttaacttaaatattatggtaagcaatacataaatattcgctaaccttcccccttcatctccacgtgcacagtcatcgctttggatcctcaaagcggttgtgttttggttttcttttttcactcagagtttctcgttaagtgtcactgaaacttgtggcataagatcgatcaacggtattaacccgaattgaatcaaagcagataaaacagcttgggcaacggctgttttagccctttaaagattccaaatctggccttgttccccatcccaaatggaagctgctgacgctggagactgtggagagaaaagggtggggcccagcacaggggcccaaggggttcaacaagccaaggtgccaggtggtggctcagggactcacggggcagacagtgtttgttatttattttaattaatggcctacacttaaaaggagtttcataagtaaacttctggcttctctagaaaaaatggatagctctttctttcacccctggaccggcaatttcacatgccaatggcagcagccgggcagtggtggccccttagacctcatacacgctcactctctttttggagaggagagtcactgtcactgtcttgtggccatttcacttattcatgcctgggctggctcctgcagacattggtggtaaagagatcagagggtgtggccaaattccagagtggctctaagaacagatcaaaggacacacacatacacacacacacacacacacacacacacacagctttgcatctaagctccatccacagtgaagttcccccagttcctctcaccttgtctcctctcagcctttgctcaagctgttttatctgccagaaacacgctcctctactgtcccctgcccacctggtcacgttctattcaaccttcatgatgtcacctctacaggaagcctcccggccccccagtgaaggttcagatggatgtcagagagacccaaagtaacagcaacttaaaaaaaaggcagacctttaattctttttcaagggagagtcctgcccagtgaaggccctcccagtgcctggactcttctatgtgccgacctatccgtgaggcacagcagacacagtgcctaggacccacgaaaatgttttaatttcatttagaatcaggaggaaaaaaagaatataatgataaatccagcctgaattatttttgccgttttactaatacagtagtaaaatataatttaacagaagaaggggcccacaaaggcaaaggtgcttagggttcccaaaagtcataatgcaggccaggcacggtggctcacacctataatcccaacactttgggaggcaatggtgggtggatcactttaggtcaggagttccagaccagcctgggcaacacggtgagatcccgtctctaatacaattacaaaaattatctgggtatggtggcacgcgcctataatcccagctgtttaggaggctaaggcaggagtatcacttgaacctgggaggcaaaggttgcagtgagctgagatctcatcacagcactccagcctactgggcgacagagcaagactccgtctcaaaaagaaagtcatcatgcagccctgggtggttactctcatctatgtggtccacgctggctcagcagtacaatggagggagagaacaaggaaggaggggataggacatttctctttaagggtttaatttgggagttgcacatactatttttccactcaacccattgtctgaaccttaatctcatggccacacccacctatagaggaggctgaaaatgctgtctttattttggattgtcgtgtgcccaaataaaaagtgtatcgcaatgtgagaaggagagggccgctattgggagaactagttccctctgctaagtgacctttctagttgctttcatggctccaagagggagcaggcagaagctgcaatgtccttgatgatctaacttcagaagccacatgccattgtttccacaatcctattggtgacacacaggccaagcccatcctgtgtaggagggccccacgccaggcatgaatatagggaggggagaatcactgaaggccatctggtgactttctaatgtctgggaggcccctgtgaacttcctgtgtgggattcagtgagaccctccttgctcttagaagagtggcccccctcttttttacttgtgtctattaagtgcatttctatgtccttggagcagacagaccctaagaaagcgatgaagggagaaaaagacactattattggtcccatcgcctgttagcaaatacaggggtctctgtggccttgtcttcttggtagcctggtgtttcttcctggtatgtggcattccaagctggcccccactcatctgcacaacaagagtgagcatcaggcctcagggatatggccccagacagaacaaagtccctgctccctggaactttccctcagtaaggagagacagacaccaaagaaacacagggcgtaccagatggtggtgttataaacataattaaagctgaataagtatgtgtgtgctattttacagaaggtgtgagggaaggcccctctgcagaggtgacatttgcaccaagacctaaatgaagagaggaagtgaaccataagaatatgggaggagggccaggtgcagtggctcacgcctgtaatcccagcactttgggaggccgaggcaggtggatcgcctgaggttgggagttcaaggccagcttggccaacatagggtgaccccatctctactaaaaatacaaaaaattcgccaggcatggtggcatgtgtctgtagtcatatatatatttatacatgtagtcatatatatttccttccatatggaaggaaaaaagtctgcaggaatttcacagtgaagaaatggacaggaggactgaatgcaagatcaggagagagtctttcaagacaggactagaacaagatgggactagaacgtgtctatagccaaggagcaactcgtgattcagggaagcagaagagaggtgaaatccagagaccaatgaaacgaaatggcctctgactagagctgagccccatctcccattgtattaatagcaggagggggctgggcacggtggctcacgcctgtaatcctagcactttgggaggccaaggcaggtggattacttgaggtcaggagttcaagaccaccccggccaacatggtgaaaccctgtctctactaaaaatacaaaaattagccgggtgtgatggtgggcacccagctactcagggggctgaggaaggagaattgcctgaatcagggagacaaggttgcagtgagccgagattgtgccactacactccagcctgggtgacagagtgagactctgtctcaaaaaaaaaaaaaagaaataaataacaggagggaaggcaggatgtggatgcagatggaagcaggttggagatgtggtgactggaaggcgaaggggtttcgtgtgactgcttctggtttctcaatggagtgtgaggctcagggtgatggccacaggggttcagaagatttgagggggaaagaaaaagatgagaatgaatgactgtcctgatgatccaaaaaacaaaccactagggcagtgcttctaaactttaattgtggaaatgaatcatctggacgcctggggaccttgttacaatgcagattcagattcagtaggtctgggtggggcctggcctcctgcatttgtaacaaactccccagtgatgcctgtgctgttggtccagcaccacgttttggttaggaagggaagtgctatggtttgaatgtgtcttctccaaaattcatgttaaaatttaatccccagtgcaacagtattgaggtgaggcctacaggaggtggttaagtcatgggggctcagccctcatatggatgagattcatagccttataaaagggctggagggaactagctgggtccttttgcccttctgccttctccatgtgaggacacagcattcatcccctctaaacgatgcagcaacgagggatggtgatgttggaagcagagacagctgctttcaccagacactgaacttgccgatgccttgatcttggacttcgcagccttcagaaccgtgagataaattcctatgacttatcaatcacccagtctgtggtatttttttatagcagcacaaacagactaacacaagaggtggataggatttgcgagcatggaccttggaggtttgtggcctcaatttaaagtgagtacattcacccagctggtgtttttctcttgctgcttgggcacagagatggagtaaatgggtctaatcaaggataaagggagagccaaagagatagtaatatttgaaaggaagtgtttttaatgatgtgccatgtaatctgagctgggtcaggaatgaagtgaaaaactaagagatgatggatgatgataggggctgtgaaaggaaaacaaatcttggggcccccaaatcactaagctaaaggagaaagtcaagctgggaactgtttagggcaatcctgcctcccattttattcaaagtcacccctctgctcactgagatgaatgcatatctgatctaatcagaaactcaaaagaatgcaaccatttgtctcttatctacctatggcttggaagccctctccccactttgagttgtgctgcctttgcttcgagttgtcctgcctttctgaaccaaaccaatgttcatcttatgtatgttgatcgatgtctcatgcctccctaaaatgtataaaaccagtttgtgctcagaccaccttaagcacatgtcatcaggacctcctgaggctgtgtccatgtgtgcatccttaactctggcaaaattaacttcctaaattgactgagacctgttcacaaggccaatgaatcatggttcttcataagattaaataattgctggtgtggaagcattagagccactaaactggaaagagaggacaaggtggtcaggaagtgaggcgcttgaaagtgagaataaggggcgacacggtcattggcgatgacaaggtcaagcaagtgacctccagagtaggaggctcaagatcatttgaggcacaaaggtcaaggaacggagaggccaaggtgtcagacggatcactctccaaagagtgacactagtagatggtcaaaatgaaagcagtgagcccaatgctcaagtctgtaagggacaaggaggaatgaccagggtactggcaggtgacagtaaccaggagggaggcaggattttagtctgatgacatgaatttcaagagagctttgtgcagcatctacaaggcactgggacagaagacagacatagtctccctcctaagtgaagtgggttaggcaaggaagggttctaggcaaggaagttacatgatccagctagattttgaaaagatctcttggactactgtatagagaatggattggagggaggttcggtggcattaggaggctattacagttacttagactgaggttgtcaaagggtggaccccagaccagcagcatcagcatcactgagaacttgctagaaatgtacattttggggtcccacctcagatctactgagtcagaaactcggggtgggggccctgccattggagttttaacaagctcccccagtgattctgatgcaagctgaagtcaaacgaaaatggtcacagaattatggcagtcgagagggagtggatgaagctacagcttgttaggggaagaataaggacagggtagcaaagtgtagcagggaaggagtgggaagcaccaggtttctgggaggaggaagtggactgttgggagtttcctgtaccccaaaggcacggggaaggctggaggaggagccgaggggcagggcaagatcaagagtttggttctgtccgcagcatggggcacatgtgttccagagaagctggctggaaagtaacgctgtgggcaagaactatattccgccgtagttcccaggagaaatgcaagacatgctcctggaggaaagctgcgctgatggctctgggacatgtcgtgacaatgacacacagtggctctctgtggtccagttaagcttgccaatattacacacttgcaattgagggcatggtggaaagcacactgagcttggaatccagaggaatcagcccctggggttaagtcttttcccaccagtcatttcacctctgtgagcctgtttctacatttctttgtttttattttattttattacttatttattttgtttctgatttttttttttttttttgagacagagtctcactctgttgcccaggctggagtgcagtggcatgatctccgctcattgcaacctctgcctcctggcttcaagcaattctctgcctcagcctcctgtgtagctgggattacaggcacctgccaccctgcccggctaattttttcgtatttttagtagagatggggtttcaccatcttggccaggctggacttaaactcctgaccttgtgatacacccacctctgcctcccaaagtgctgggattacaggcgtgagccaccgcacccagccgtttctgcatgtcttaacagggattatgatatctgcctgaactacttacagggtacactgttagagccaaatgagccaatgcaaatccaaatttattgataattctaaaattgtttcaatgtaagtgcagcagtattccaaataatctaataattattctaatattctattatcaaaactgctttttttgctggtagctgcccacctgctatcatgtgatggcagtagaaagacgaccaatctctttaaacacactttccttcctggttatggccttcaattcactgtatgaggtcaatcctttgactgaaacttttgcctataaaattgcagtacacctggaatggtaacactacaaaaaatacctaccttttatttactgtgtactacgtgctggtgtttcatatccactatttcatatgccttgaaggagtcttgtgcactagatattgctatgctcactttatagatgaggacattgggctcagagaccaggggacttacccaaattcatagagctcgtggagggcagagccagcacctgactgtttgtgcctgcctgtgatgctgtagtctccctgctcttgcaagcagctttggatgggcagggttagggcaccggtcatcaagcctgggaaaagggagcttagctggacaagggaaggatgccaaaggctggggcttaaggatcagattcagttgaccctacccaaggcacaggaattgttctatggactttctgctctgctcttatgacttttattcacaagcagctttctaatgtctcaaccttccatggcacccaatactatttgcttagatatttggtggtgaaatctttcaacagaaatgatggaagaactaagggcccagggagggctccagaggaaggtggactccttgcgtcctctaacctatagaacaaatgcacagaggggctgggcgcagtggctcacgcctgtaatcccagcactttgggaggctgaggcaggcagatcacctgaggtcaggagttcaagaccagcctggctaacatggtgaaaccctatgtctactgaaaatacaaaaattagccgggtgtggtggcaggcacctataatcccagctacttgggaggctgaggcaggagaattgcttgaacctggaaggcagagcttgcagtgagccaggatcatgccactgtagtccagcctgagtaacagagtgagactcggtctcaaaaaagcaaaacaaaacaaaagaacaaatgcacagaggggaggggaaggaggctgccacagccctggggtctcttttccaggggtatttttttttttttttttttttggagacggggtctcgctctgtctcccaggctggagtgcagtggcgcaatttcggctcactgcacagccgcctcctgggttcacgcgattctcctgcctcagcctcccgagtagctgatactacaggcccggcccccacccccggctaattttgtttttgtatttttagtagaaacgggtttccccgtgttagccaggacggtctcgatcttctgatctcatgatccatccgcctcagcctcccaaagtgctgggattacaggcgtgagccaccgcgcccggcccaggggtcttaatacagttcattttgcacacgaacagcattatgccttgtgaactttggtgcaggcgggagagcgattagaggagtttcaagactggtagtcgatgataccagcatgtgacatgagagatcggccgagccaggaaggagcccatgttccttatctcatatacacagaaaccaagggccttgtccccaggcccaggattgtttagcacaacagaatcccagcctccccatgtgttactcaatcgctttaatcctcttaaaaagaattgccggccgggcgcggtggctcacgcctgtaatcccagcactttgggaggccgaggcgggtggatcacgaggtgaggagatcgagagcatcctggctaatggtgaaaccccttctctactaaaaatacaaaaaattagctgggtgtggtggcgggcgcctatagagcaagactctgtcgaaaaaaaaaaaaaaaaaaaaaaaaagggttttctgatcgtgctcttggtaccagttctcctgagagtgagcttcactgtgctggatcacaaatgtccggtggaaagacatctagctggggccatctctccacagccacagcacagagccttgcatgagagggagggagggagggatggatgggtgattgccggaagaagatgcagaatatcccctggactgcctccaaatacaagttcagtgatatagaacttcaaattggttagtttttctggcatgaaaggctatgtcttgggggaacacctctcccactgccccgcagtgtagataccagcagccgagtacatgtagttaccactgtttttgtttttttttatgggtcctggctccttcaatggagaggcagtaagcaattaaaacccgcttctaaaccatcctaagtactcctttggagtggctgcaaaaatcgatcatcctcacggatacaaagggggagaaaagaaaaacaaaaggaattactttaacatcttcattttcagactaggttagggcagtaaaaaagatgaccagtggaggcaaacactggtttagggctgtggcagcggcagtggggttccggagagagaagggagggtaacagaggctcttctgatcctccttgcttctggggtctcttgctgggcctctgagtaggtctgcaagtagggctgggcatcggggctcattttgaccacaagtgtttgctggttttggagtcaggcagacatgtgtcactgcctggatttaattcccatagctgtgtgaccctcggccgtttgcttaatgtctctgagccttaatttactcacctgggaggaacaataggactgttcagagtaagtgaagtagcacactgggcgtcagggcacgttcggggccgcgccggcacgcagagaacctcgcccgctcggcattactgtctggaaacggcttgcggggacggtggaggataacagggggcgagcaccgcccgcagccggagtagccctcgcgttttttccttgacagcgcggccgagcgccgctgcgggttgtggagactgtccgccctctagtggtcggcttcaaaagttgcttcaaagacaaggctgaatgaaaagcgttggggcgccctaagccgatgcactgcatggaaagggggctacctttccctttccctttactagagcggacaaaggctgttccatcttttttgggagccatagaggggatccggttgcactagcctgcatcctcaggctgctgaactgaccacggtgggctaaactggaaaagtttctttgggcaggaaagactcagatttaacaaacatttactgagcacctactacgttcctatctctgtgcaggatgctttcacttactttacccatttaaacctctcagtaagaccgggcacggtggctcacgcctgtaatcccagcactttgggaggctgaggagggaggaccgcttgagttcaggagttcaagaccaactaggcaacagtgagacccctctctacaaaaattaaaaagttagctgggcatggtggcacacgcctgtggccccatgtggccccagctactagggatgctgaagtgggaggattgcttgagcccaggagatttgaggctgcagtgagccacgattgtgccattgcactccaacctgggcaacagagcgagactgtttcaaaaaaacaaaaacaaaaacaaaaaacctctcggtaacctgtgagtgagagtttaaatattgtttttctgataagatggtgaagcactctcaggaaagttattgcacacagtggaatcatggctacgtggctacctcaggatttgtattagtacacttagggctgctgtaatgacctaaacatgggtggcttatggcccatcctaataacctcactttaattggattacctctgtaaagattctgctctaaataaggtcacattctgaggtgtaggggttagaacctctacatataaaatttcaggaaagtaattcaactcataacaggattttttttaatttcttttttttagagatgaggtctcgctatgttgcccaggctgatcttgaactcctgagctcaagtgatcctcccacctcggccctcaaacatgctaggattacaggcattagccactgcacctggccctataacaggatttaacccataactcctgatcccaagcctgatggttacctgtatattcaagcagtgcttcttaaacgtggatgtatattggatttcctggagaattttaaaaaatatattgatgggccaggcgtggtggctcatgcctgtaatcccagcactttgggaggccgaggcgggtggatcacctgaggttaggagttcgagaccagcctggccaacatagtgaaaccccttctctactaaaaatacaaaaattagccaggtgtggtgccacacgcctgtaatcccacctactcaggaggctgaggcatgagaattgcttgagctcaggaggtggaggttgcaatgatctgagatggtgccactgaactgcagcctgggcgatacagtgagactccgtctcaaaaaaaaaaaaaaaagtgtgtatgtatatatggttttgagttcacctcaagagattacgatttaattggcacatagttgacatagttgtgccaattaaatgtgtatagacactggattaaaaaaaaaaaactcctcaggtggttctaaggagaggtcaagattagaaccattgacttagagcaccttcccatcaccatttgataggctccacctcagaggaaggataagccctctccttgcttcgctgccagggaaaggaggcccaatttgtctttagttctgcaatcttggctccatttcggtttctatttttcttattcttttttttttttttttgagatggagtctcgctcttttgcccaggccggagtgcagtggcatgatcttggctcactgcaacctctgcctcctgggttaaagtgagtcttctgcctcagcctcctgagcagctgggattacaggcgcctgccaccacacctggctaatttttgtatttttagtagacatgggtttcactatattgaccaggctggtctcaaactcctgacctcgtgatccgcctgcctcagccccacaaagtgctgggattacaggcgtgagccaccacaacaggcctatttttcttattcttcaagcacatctgctcttcacacatgtcagactcacagcctagtacatgacacacattaggcccttaacaaatatctgaagaagaaaaggagggagaagaatcacaagggaagaagtgcaaagggatgggattggaataggggaactcttgaaaaagtgatgtttctggaaaaggaggatttcatggtacccactgggggagaatattagtgcaaatagtgcccaatgatggataatcatccagggatttgccttccagtgataccacataagggcatcaaatcacattcacaaccttaaatttaatagttgtgcatgaggtgaggacgaattaccttggggtatcagttccccttcccaccaaacccccagagctggcacatgacagtccaacaaggtctcctccgaatgctgagtgccctggaaggcagagtgaagctctgaccccattgtgttgtgaggtggagagtaaatgacagtggtttccttgtgccctggcttgtttctcccccttgggcttcatccattctcaccctcagagctaactggggctgactgggaatgagctaattaggactggcctttccctatatgtgttccccagaaaaggagcatataccttcaggaaaacatgaattcacaggtcaaagtagcagatttcagaatcacaactatgtgaaatgaaacatagcattttagattacagaatccaactatatatataaaaacagttgcatagataatgtgatattggcctaataaatatacaaaaagagataaaagaagataatgacaatgtagataagaacaagaaaacataaaaaagcaatattagataagtaaaatatcatagttgaagtgaacacatcacatggataaacaacaaaatggatagagctgcaaaactaattgtcaacttggaagaccaggcggaggaaatctttcagaagagataagaaaataacaaagacgtataaaatataaagaaaaaactaggttatgtggaagacagaagtactaacatctaggtaataagaattctagaaagaagaaaaatgaacagaaagaaatgtttgaagaaaaatgagataatcttccataactgtaaaaagatgaaagaaagataaaaaaggttatagaaaaaagataagaaaaaatccacaccagaacattttatagtaaaattaagaatttcaaggctggacatggtggctcacacctttaatcccagcactttgggaggctgaggcaggaggatcacttgagcccaggagttcaagaccagcataggcaacaaagtgagatcccatctctacaaaaagttttaaaaattaggcatggtgatgcatgcctgtagtctcagctactcaaaaggctgaggtgggaggatcatttgagcccaggagggtggggctgcagtaaactgtgatttcaccactgcattccagcctgggtgacagaacaagacatcatctcaaacaaacaaacaaaaaaacccaacaacaacaaaaaaaagaattcaaggaaaattctaaaagattataaagagaaagagaacatcacaaaaagaggactgaagtcagattgacatcagatttttttttttttttgagacagagtctcactctgtcacccaggctggagttcagtggcacaatctctgctcactgcaacctccacttgccaggttcaagcaattctcctgtctcagcctcctgagcagctgggactacaggcacctgccaccatgcctggctaatttttttttgtatttttagtttttacagggtttcaccatattggtcagggtggtcttgaactgctggcctcaggtgatctgcccaccttggcctcccaaagtgctgggattacaggcgtgagccaccaggcccggcctgacatcagattttttaacagcaacaactgatgtaagaaaacagtggaatgagctgggcatagtggctcacacctgtaatcccagctactccagagggtgagatgggaagattgcttgagactaggagtttgagaccagcctgagcaacatagtgagaccccatctctaaaaaaatattttaaattagccgggcacaatagtgcactcctataggcctagcttactcaggatgctcaggtgggaggatctcttgagcccaggagtttgcggctgtagagagctatgattatagtattgcattccagcctgggcaatagcatgagactccatttctaaaaaaaaaaaataagagaaagaaaaagggaaaaaaaaaaagaaaaaagaaaagaaaaaaatggtggaggaatggtatggtattctcaaaataataaaggcaaagaaaccatcctcaattttatttatttatttatttatttatttatttatttatttatttatttttgagacagtgtctcgctctgttgccaggctggagtgcagcggcacgatcttggctcactgcaacctctgcctcttgggtttaagcaattctgctgcctcagcctcctgagtagctgagactacaggtgtgcaccaccacgaccagctgatttttgtatttttagtagagacagggtttcactatattgactagaatggtcttgatctcttgacttcgtgatcctcccacctcggcctcccaaagtgctgggattacaggtgtgagccactgcgcctggcctatttatttttttgagataagagtctcgctctgttgcccaggctggagcctggtggtgcaatctccactcactgcaacctccacctcctgagttcaagcaattctcctggattagcctcccaagtaaatgggaccacaggtgtgtgccaccaggcccgactaatttttgtaattttagtagagatggggtttcaccatgttggccaggctggtctcgaactcctgacctcaggtgatccacctgccttggcctcccaaaatgctgggattacaggcgtgagccaccatgccctgcccatcctctatttttatatccagttggccattcaaagataagggcatgataaaaaaaaatattatcaggcacagaagttctcagaagatttaccacacaaaggctatgctgaaaactattttagatgaaaggcttaaataaagggagagtaaatctagtagatactgccagagatatgtaaagtaaagatgaccaagtacaccggtaaaatttctttgacttaaaagaatagccaagactaaagaaaaagagaactcatagacacaataatctggcatcaaagtgtagataataacatgatgtggattgggggcacagagatgaagagatgagtgtataaagttttgttcttatgggggaagagatagttaccaatttaaagaaatggttaataatatatatagaaaaagtgagtcagactgaaaaaaaataaagtggtagaaacaggtccgaataaataattacaataaatataaatgaactaaactcatcagttaaagacaaagatggaaaaatgtgatataacaaaaattcaggtatgtgctattaacaagagataaaactaaagcataaggaattgcaaagactctaagtaaatgaataaaaaagatatcagtaaaatactaatcaaaataaagctggtttatctacagcaatattagataaaatggacttaaaggcaaaaagatacatagcatgtatgcatttaataaagcaaaaggtggcccagggtgatggctcacccctgtcatcccagcactctgggaggttgaggcaggtagatcacttgagttcaggagtttgagaccagcctgggcaacatggcgagaaccccatctctgaaaaaaaaaaaaaatgcaaaacttagccaggtgtagtggtgcatgcctgtagtcccagctacttggaaggctaacatgagaggatcatctgagcctggggaagttgcagtgagccatgatcatgccactgcactccagttggtgataaaagaaaaagattgataaatgttgctttgttagagaaagtaaaaagttatatatagaagatattcaaaacacataaaactggcaaaggactggtatcataaagaacttctgcaaatcagtaaaagaaaaaacacataagcagcccaataggaaaatgggccaaaaaaagaactgttttcacagaagagaaaacacatgatcaataaacatatgaagagatgtttaacataattagtaattgggaagtataaattgagactacagtccgggtgtggtggctcacacctataatcccagcactttgggaggcctaggtgggcggatcacgaggtcaggagattgagaccatcctggctaacatggtgaaaccccgattctactaaaaatacaaaaaaattagctgggtgtggtggcacgcacctgtagtcccagctactcaggaggctgaggcaggagaatggtgtgaacccgggaggcggagcttgcagtgagctgaggtggcgccactgcactccagcctgggcaacagagcgagattccgtctcaaaaaaaaaaaaaaaaaaaattgaggctacaatggcacacaattttatactcattcatctggtaaaaatttgaatggtctgataacaccaaatcttatcaatgctggtgagaatgtaaaattgtataactactttggaaaagtttgacattttctcctaaatttgggcattcatatactattatgggttgaattttgtcccctagaataaaatgttaaaattctaactcctggaaccttcaatgtgatcttatttgaactttgcagatgtgagtagctaggttataatgatgtcatactgggccctaaattcaataggactggcatccttataagaaaagaagaggccaggcacgggtctcatgcctgtaatcttagcacttcgggaggctgaggtgggtggatcacctgaggttaggagttcaagaccagcctggccaacatggtgaaaccccatctctactaaaaatacaaaaatttgccaggtgtggtggcggacgcctgtaatcccagctacttgggaggctgaggcaggagaattgcttgaaactgggaggcggaggttgcagtgagctgagattgcaccattgcactccagcctgggggacaagagtgagacttcatctcaaaaaaaaaaaaaagaagaagaggagagacagagacagaaacacacagaggagaagaccatgtaaagacagagatagaaattggagtgatgcatctacaagccacggggtgtccagggatgctggcaaccatcagaagccgagagagacatgggacagattttccctcagaggctcccatagggaaccagccctgaggacacttactgtgagataacacatttctgtttttttgaggcacccagtttatggtaatttgttagagcagctctatgaaactaatacacatactcaatgacccaacaattctactcctaggtatagacccaacataaaccatttcatgtgtacaagtgactgcataaggaagttcacaggatttcagttcacaacagcaaaaacctgcaaagaacctaaaagcctaactataaaagacagaataaataaattgtagtaaatccacgcaatggaatgttattcagcagtcaacatgaatgaactatagcaatgagggggtctatctgcagaccctgacccaaacgatggatgaatgaagtacactgacacacagatattctgctatgccagtccagctgagtgtctgggccacttacagactccaagcagagtgctgtaaacagtcacgaccatggccctgaccaactagtgagactcgcatttatttagtaaagatgaattgacaaaggcttgagtcaacaccaccagagggtaattgacattgtggacttcctgtagaaagtaattaagcaccggtggtagatcaaaggttagtcttaaacaacctagctagatacactactctgccttcttccttacccacttgaagctttttactcaaggtaaggattaggttgccttcagccattgtcttatcctgagacttctgtaaaaaccttcaggccttccaagaaagtttgtgtttatttttataactatctttaatatttttcccaccagcctgattgaactcccacataacaacacacaaaaatatgaggaatcttaacaatataataataataaatgaatctaaagagtttacatattctgcaatgcatttttaataaaatttatgaccaagataatagttcctttttatgaatgcaaatacgtgcaattcaactatatgaaatggaaggcaaggaaattgtttttttatttttttgcaaacactatggtgacttaaaggcaaggaaattgttaacatggaattcagcaatatggctaccttgagtagacaaaggcagagggacacgatgggaaaagcaaccatatggttagatgtaggttgttgtcaaggtcttagtttttgcttgagatggtgggttcatgagtatttatctatgtctacagctatgtttatatgtatattaacataacaatatttaatggaggaggccacttaaggaccacagaggaaagtatgccataaataggattagaactaattcttttttttttttgtcttgagacagagtttcactcttgttgcccaggctggagtgcaatgccgcgatcttggctcactgtaacctccgcctcctgggttcaagtgattctcctgcctcagcctcccaagtagctatgattactggtgcctgccaccacacccagctaatttttgtatttttagtagagatggggtttcactatgttggccaggctggtcttgaactcctgacctcaggtgatccacccgccttggcctctcaaagtgctgggattacaggtgtgtgccaacgcatctggtagattagaactaattctaatccaatcctgtgcatctggggctaaacatcccccaaattgttgggctttcccagatttgtccatgattctacaaactggtgcttctggctaattctgattttcacaagggtctggaaattggaatattttttccacgctaactctatgacctgcagtgtggctaaccaatctagaccaaacatgcagctctggattgttcaggatttagtgtgccaatttagatagaaagctcaattaattaaaataaagaagcacagagaccaaaagttcattgagttcaagtagaatcagctcaatgggtgggaaaaagaaaaaagaatcagttcctataaaaaaggacagcatagttgctagaaccctctagagatgtacagatattagatagttttggcaggaagtggtggccaaaatacatgaaacaacaacctgaaaaaataagagttaatcagggattacagcagggatgaaaacaaacaagccaaaaagccacagcaacaacaaaaacaggtggaagataacaggaaaatctaatcttcactgcccatgggctggaatgtaatgttttggctatgtttttcttcttcttttttttttttttttttttgagacggagtttcgctctgtcacccaggctggagtgcagtggcgcgatcttggctcactgcaagctccgcctcctgggttcacgccattctcctgcctcagcctcccgagtagctgggactacaggcgtccgccaacacgcccggctagttttttgtatttttagtagaaatgggatttcaccgtgttatccaggatggtctcgatctcctgacctcgtgatctgcccacctcggccccccaaagtgctgggattacaggcgtgagccaccgcgcccggccttggctatgtttttcttggtaaacatctctactatctgcttttgaaatgatggagctacctttcagttttaaaaacaatatatttcaggcatctcaagtaatccacaatctggaggcaaaagtcaagactgagttgacagagcacaaatctgtttcatttgactacattaaagaggtttgcattctttcaagggcttactagcgagttgttcagaagcagtactgacacgggggcctgggattgttgagggatgcttatgcacagagaggaaggtttgctaatccaggagcactgaatcatcatgatgtaaacttgcaggacttcatggcttcagtgatacatcattgatctttaattccagtccacagaacttttttttatggtaaggaaaaggatatgggaagaaaaaagtattataagcatgtttctcatatttcttccctcttttaccctataaataaaagagcaaaggtattactgagcaaatgttctcttgaaaaacttgatttcttcttatgcttggaaattttgctatagagatagtcattgctactgtttacagtagacattccaaccctgaaaactaaactctgaagtatttactatgcttagataaatcacatatttgtcctcatgagtacagcctgttcaggtttgtacataccattgcgtaattccctaagaactctttccaatttaaaaggatgactttggacacctttgtggaagttgataggaaagatttttgctctttaaaatacttgttaaataggccagttaaaagtatgctttgtactgaattttgcctttatcagtaaaggctccaagaatgttgataaaataagagaaaaagaaattgggcttttctcctgccagaattggaagggagagacccaaaactaagaacggaaaatctgtcataataatggcagaatcctcaaaagaagatacacaaataaatgcagctgaggaacctggagacttccctggtttctgtcccttgtgagacttcaaatcataaaataccctaatatctttctgtaatcttctgtcatgttctaaaatgtctaaaatattgaaacagtccttattatcagaaaaaagtaatcatgaacagagcccagaatatggtataaaacattaccttactgttctcatcatgtcattgttcagtcctacctccaaacaatgtcccatgagaaaacccagaagacatctccctcactaaagcattgagaaatgcattaataaatggagcacctgcaacctctttcaaaggagagctctgtggttgctctcttctatagggtaggtggaaaatatgccattgacatggtctccccaatttcaatgatgggatgatgggatctcagagtggcataggtaggggtggcactgaatctccaaggacaaagtaaatgcatccactgtaaagggcaatcagaatgctttggcctgcagacatatttgatggtggttaagttatggtgttcttaggaatgaaatagatgggcaatctaccattgtattgcttgatctgtaacagagggaaaaattctaggtctggtagctaaaaacctgatgagtcactgcagtggacagtcatggcctcttgtgttgagatctaagtcaattcacagagccaaagctccttgattaaagaggaggctgggagccaggcacagtggcccatgccatcccagtgagtcaggaggctgaagcaagaggattgattgcttgaagccaggagtttgacctcagaccctacgaaaaaattaatctaaaatgtcggggcgcggtggcccatgcctctaatccgagcactttgggaggcacaggtgggcagatcacaaggtcaggagtttaagaccagcctggccaacatggtgaaaccctgtctctctaaaaatacaaaaattagctggggatggtggcatgtgcatgtaatcccagccacttgggaggctgaggcaggataattgcttgaactgggacccgggaggcggaggttgcagtgagccaagattgcaccactgcactccagcctgggctacagagggagacaccatctcaaaaaaaaaaaaaaaaaaaaaaaatctaaaatggatcatagatctaaatgtaaacctagaattataaatctactagaaaaaatataggacaaaatctgtgggaccctggcataagcaaagttttcttaagtagaacacaaaagaagatataaaagaaatagatggggcttggcatggtggctaacatgtgtaatcccagcactttgggaggccaaggtgggctgaccacctgaggtcaggaattcgagaccagcctggccaacatggtgaaaccccatctctactaaaaaaaaattagccgggcatggtggcacatgcctgtaattccagctactcaggaggctgaggcaggagaattgcctgaagctgggaggtggaggttgcagtgagccgagatcacaccactgaactccagcctgggccacagaagaaaattccatctaaaaaaaaaaaaaagaaaaaaaagaaaaagaaataggtaatcagttgggcttcatcaacatttaaaacatttctctttgaaagtcagttaagaaaatgaaagtcagctaggtgtggtggcttacgcctataatcccagcactttggaaggccaaggcaggaggatcacttgagctcaggatttcgagaccatcctacgcaacagagcaagaccccacctctagaaaaaattttaaaaattagccaggcagggttgtgcgtgcctatagtcgtagctatttggaaggctgaggtgggaggatcacttgagcaaaatcaaaactgattttcattaaatctcaaagtaatctgttgactgaaagaaaccaaacaaagatatatattgtattatttcacttatatgaaattcttgaaaataaaaactaacttatgtagctagactgcagatcagtggttgcctggggacaggttaaaaagtgcaatgaactgcagacaggtatgagaaaaccttcaatggcaatggaaatgttcagcatcttgtttgtggagatggtttcatagttacatatgtttaccaaaacttatcaaatagtgaacttcaaatatatgcagtttattattcaaaattatacttcaataaagttgtgaaaatgggagcggggaagcaacaaatactggtgtgagtcaacagcatgaaccatatcaccttttctcattttccagaagtatgctgagttccttggtcagccaaaataaccaccctctcgcccatatgagaggatcttccttgtccattttcccccatagtacctgtcattttttttttttctgctgctataacaaaggaccacagattgggtcactcataaagaaaagaagtttaggccaggcacagtggctcacacctgtaatcccagcactctgggaggccgaggaaggattgcttgagcccagaagttcaagaccagcctgggcaacatgatgagaccctgtctctacaaaaaatacaaaaattagctgggcatggtggtgtgtgcccatagtctcagctacttgggaggctgaggagggaggattgcttgagccagggaggttgaggctgcagtgagctgtgattgtgccactgtaccccaacctgggcaacaaagcaagaccccatctgaaagagaaagagagagagaggggataaaaaagagaaagaaagaaaagaaaagaaaagaaaagaaaagcttacttggtgttgcgggaagtcagggaccctgaatggagagactgactggagctacggcagaggaacataaattgtggagatttcttcttaatatggacatttatcagttcccaaataatactattataatttcttatgtctgtctttaatctctttaaactttaatctcttaatcctgttatcttgctcactgcaagctctgcctcctgggttcacgccattctcctgcctcagcctcccgagtagctgggactacaggtgcttgccaccatgcccagctaatttttttctttttgtatttttagtagagacggggtttcactgtgttagccaggatggtcttgatctcccggcctcatgatccacctgcctcggccttctgaagtgctgggattataggcatgagccacagcgcccggcctgatcagaacattttttaatgaaaggatctagaaagcaacttggaagtgtaaatagtcaccttcattttctctaacttgatcaagactagtgggtccatggccctgtgttagttcatgcattcatctcagacccaaatgaaagtttcaactcccaaaatgcagttccttagatgctcgtctggacgtgatgacgtgcccgccatataagaaggtgcaatcataggtatcacaggtagccagatagaagacatttttttctcccaaaattattccttggagtggggagtgatatgggggaagagctcccatcttaaggggcacacactgagttgcttatgctacttccttgttcaaaatgaagtaactgccttaatctaaaaaaagaaaagaatatttacaacactgaaaatgaatgaactacgatttatgtatagcatggatgaatttcataaacattggacaaaagaatccagacacaaaatagtggttgcctttgggcaatatagaagggtgcaagtggaagtagcctcaagaagttttctggggtgctggtaaggttctattttctaaactatgtggtgattaaatatgtgtattcactgtgtggtaattaatcaaactgtttactttttttttttttgagactgagtctcgctctatcgccaggctggagtgcagtggcttgatgtgggctcactgcaacctctgcctcctgggttcaagtgattctcctgcctcagcctcctgagtagctgggattacaggcgtacgccaccacacccagctaatttttttgtatttttagtagagacggggtttcaccatgttggccaggatggtatcaatctcttgaccctgtgatccaccagcctcgggctctcaaaatgctgggattacaggcgtgagccactgcgcccggccaacttttaaaaaaaaatttaggtaaaacccacataacatgtaattgactatcagccattttaaagtggacaattcagtgggatttagtgtattcacaacgttgtgcaaccaccacctctgtctagtcccaagatattttcctcaccccaaaagggaaccccacccatacccatcaagcaattgctcctcattcttctgagctgttacttttctacacttttctacaagcatgttttacttcaatttaaactttagcccatgaaatctaggcaagacgaggaggagaatgaagtcatataggagctgatgaatgtcaagccatggtggggtgggccactgggttgaagattttgaaaaggttgaagaagtatggtagtggacgcacttgagtaagtgaattgaaaggaaagaggtagtggtcagagggtaggatgcttaaataaagatttcacaaatgcgttcatttctgttgatcccaaggaagtgaccgtgtgagtgtgtagctgaggtggaatggtgaaaaagatcattgaggacacatctgttaaagacctaagaagccagagcattgaatggttcaactacatggcgttaggtggttccaaccaatcaatgctgaggtcacaaaaatgggtaaaaatgacatggcaggagttggggaggaggggaaaagcaggaagctaagtgcaagtctctcctgcatggaggggcatcgccaagaagtagctcacagcttcaaggaggaggtcaagggagttagatgacctgaccttcagaagagctgaggattttggaggagggaataggaattggaaactgcaactgcaggccatgaggacactgcctaataatgccacagtggccttggggacagccatgtttcaggtagggcaggagaagagatggaggatgtgggagagtttaagatcacagagaggagcttctgagaacacagcgaggtgtgggagaggcagtgcttgcatcatattggaggacagacatggcaacacaaagacaggtaggttgggggtgactggaaaacaggatggaggctggactggattcagcctgaagatacactcagggtgagggtggcaaccagacccgacgacgtgtgtcctggcaatttctctccaagaaaccactagtgatgaagcagtgctttaggtgcttgggggttgagcaccttcctgatatgtagtgttaacagcttataaatggctatgtgtgacttttttttcttctgatcaacgctggtccttaatcaccatgttggattacctcctgctatggtttgagtgctagtcccctgcaaaactcatgttaaaatttatttgccattataacagtatcaagaggtagaacttttaagaagtgataagactatgaaggctccatcttcatgagtggattgatgttgttataaaagggagagtttgaccctcttttgtcctctcttgcccttctgccttttgtcatgtgatgatgcaacaagaaggccctcaccagatgccagcactttgacactggacttctcagcctccagaactgtgagctaataagttcctgtttattgtaaatgacccagtctcacatgttgttatagcagcacaaaaatggactgagacaccttaagagggagatacatgctgctgtggtggatatattagagattaatttagaaagattattaaatcactgaagaccttttaaaaattgattttctttggccaggagcggtggctcacacctataatcccagcactttgggaggccaaggtgggtggatcacgaggtcaggagatcgagagcatcctggctaacacagtgaaaccctgtctctactaaaaatacaaaaaattagctgggtgtggtggtgagtgcctgtagtcccagctacttgggaggctgaggcaggagaatggcgtgagcctaggaggcggagcttgcagtgagctgaggtagcaccactgcactccagcctgggtgacagagcgagactctgtatcaaaaataaaataaaataaaataaattttctcaactacaaagatagtgagatcacaattattatcatggtccttaagatttttttgacattgaaaagtactttgtaaagcatatatgtgataaaacacttgaattcagactacataaagaacactcaaaactcaacagtaagagaacaacaacctaataatggggaaaaaatttgaacaaacactccaccaaagaagatacacaaatggcaaacaagtacatgaaaaaatctcaacgtcatcagtcattgggaaaatgcaaactgaaaccacacacagaaactgtgaaaattaaaaagactgaccatgattagctatggcagggacatggaagaactgggactctcatacacttctggtgtaaatattaaatggttaaatgttggaaaacagtttggcagtttggtaagagctaaatgtacacctactgcatgatccagcccttccactcctagtatttatcctgagaaatgaaaacatacgtccacacaaagacttgtgtgccaatgttcatagcagctttatttgtaacataactaaactgggaatagcccaaatatccattaacaggtgaataaacaaattgcgatacatccatgcaatgaaatactactcagcagtgaaaaggaatgaatggttgatacataccacaacatgggtgaatctcaaaatagttatgtagagtgaaaacagccagatcccctccattaaaaagaagtatatacagtatgattttatttatataaaattctagaagattagatttaatctgtagtgacgaagagacaaaggaggtgggatagaaagaggcagagacgggggttaccaaggggcaggaggaaagtttttggggtgagatgggtatgttttgtcttgagtgtggtgatggtttcatgatttatacatatgtcagaacttatcaaaggtccggcatggtgactcaagcctgtaaacctggggctttgggaggcagaagcagcaggattacttgaggccaggagtttaaggctgccatgggctatgactgtgccacttcactccagcctggataacagagtgagactctgtctctaaaattattttgccaggcatggtggctcatacctgtgatcccaacacttggggggctgaggcagaaggattgcttgaggctaggagttcaagaccagcctaggtatcaaagcaagaccccatctcaacaaaaagtttaaaaaattagccaggtgtggtggcacacatttatagtcccagctactctggaggtgggaggattgcttgagcccagaagttcaatgctgcagtgagctgtaatagggccgctgcacttcggcccaggtgacagattgagaccctctctctctctctctctctctctctctctctcacacacacacacacacctccacacatacacacaattgggatgatagtagtaactacgtcagaggcttgtggtgagaacagaaagcattcagaatagtctctggcacgtatagacagtcaataaatgttagctaattttagaaaaatatttctggcaaaatatacataacataaaacttaccattttatatgtggtaaaatatcatttcaaccattttaagtgtataatgcagtggcattaatacattcacgatgttgtccaatcatcacaactacctatttccagaactgtttcatcttcccaaactgaaacttcaaagccattagacactaacttcccattgtccctcctcccagcccctggcaacctctattctacttttgtctttatgaatttcactaccctaggcacctcatataaatggaatcatacaatatgtgttcttttgagtctggtttatttcacttagcgtatgtcttcaaggttcatccaggttgttgtgtgaattagagtttccttcctttttcaggctgaataaaattccttgtatgtagacaccacactttgtttattcattcatcagttgatggacattaaggttgcttccaccttttgagtattgtgaataatgctactatgaacatgggtgtacaaatatccctttaagcccctgctttcaattctttgggggtatatacttagtgaaattgctgggttatatagtaattctatttatttttttgagatggagttttgctctgttgctcaagctggagtgcagtggcatgatcttggctcactgcaacctctgcctcccaggttcacacaattctcctacctcagccttccaagtagctgggatttcaggagtgcaccaccacgcccagccactttttgtatttttagtagagacggggtttctccatgttggccaggctggtctcgaactcccaacctcagatgatctgcctgcctcagcatcccaaagtgttgggattacaggcatgagccaccacacctggccggtaattctatttttaactcttttatggaactgccaaactgtttccaaagtggctatactacactcccacaacaacacacagggattccagcttctcggagtcctggccattccttgttattttccaactttttgataatagccttcctaatgggtatgaagtagaaaaaaaaattccattttttccaacagatgctgcaacctggccgttggccgataccttttgtttggccttgaatagttttatacgtaggagccaatactttgaaaccagcatattttacagggagagagagagagagtgagcaagcaggagctggcttcttttggaaaatcatatggaaactctgagcccacattcttgaacctgtgaatgagaggtagttgcccttgaggtgggggcaagggccacgtgcttccctccggacacacatggaaattgtacaggatactggggaagtgaagagggacgtgctcagctcagctcagctcagcactggctgtcccgcacacctgcacttgagggttgggttggggtccgggcagtgtctgacctggtggcctcccaccctccccacttcccccaactcacaggactaagccaatgcgcgtgccctctgcctcattgtttatcgtgtctccctgccctcatgggtctttgagtttgagacactctgtgcaagaactaagcctgtgacaagagcgcttctgtcgactactctgtcattagcaagggtagaggccacagggaatagttcattagttccttcactttcatcctcccctgcaccaacacaatctatcctgcaattaagggaaagaaacccagggaagggaccttggtggcctccatggaaagcccttgtcagccagtggagatgggacattgagttgcaatctagagtgactggagtgatagtagtgagacataataataacaggaagacatagcaagacattgtctctacaaaaaaaaaaacaaaacaaaaaaacaaaaaaaactgggtgatgttgacttgatcaccagttgattatttcttacttcttggacccaacatatattgagcacctgccatgtaccaagcacttggctaggctctgggaacacagcatggttcctgctctgttccaggaggatttgggagctcttgagacactgagcttggttgagtcattattttattcatcatgaaatcactagaaaaagatggaaacttgaactgcaaacattgcttggatttatattctaaggcactggttctcaaacctgaatgggcttcagaatgacctggtgggcttgttaagacataggatgctgccacctcccaaccccaccaccaatacagtttctggttgagtagctctggttcagggcctaataactgacatttctttttttcttttcttttttctttttttttttttttgaggcagggtctccctctgttgcccaggctgagtacagtagtgcaatcatggctcactgcaaccttgaactcccaggttttattgatcctcccacctcagcctcccaggtagctgggattacaggtgtgagccaccacacctggcctgataattggcacttctaacaagttatcaggtgatgctgatgctgctggtccagggacacactttgagatccactgttccacgaaaattatgccagggctggtctaagaatattccctttccttcatttgttctccttaaccaatcatcctgacccatacggcagccattgctgttagatgttactggaagattgaaatgactggctgtctccatcgcaaacctgaataattgtagggctagaaatgagctatccctttggctgggctgcggcttggggaagtaattacctcagaataacgaagcagtcacttccagagtcattacttctgcatgcagagatggttcaagaatccttggagaaaccctatcaagtcctggcctacttgaagtcagtattgaggctttccctggcagtgaaactactgaggccaagattgctttcccaagctggaaaaaacggcatcccagatgaccaccctgttcctgcagacacacatctgggcttctagccactgggggcaccagaggctcaccgttttaactttttctgagcaaccaagctgctctcagcttgttgattcaagaacactcaacctgaaaagtctacaggctcttatttaaaatttgtcccaatcaagaaacaagtattattattttgtgtattcctgaagtctatgctagaaatggaggagaatgggaggaacccgcaatcaactgtccattgtgggtgtagattagtatctgcagccacatgggtgatttttttttttacttgcagttagcatttgtcctaatttgagagaaatcaggaccttcatggtggcataatcataaacaacgttttacttaaagcagtggttctcagcgttgattgaacattggaatcacctagctttataaaggattgaaactgatagccaaagctgggacgagttaagcaacaaaattaataaaatagtattggacccaacatataaataaatatcaatgagttcatactaacataaatatacaattaaattaattaattatttaatttgtggtgggagaattcctaataatgtgcacaagaattccaaataatgtatgtagatactccaccctcaaggagctagagcacaactccctataactaaagtgtgagtagcaaacagtgactctcttccaaagattacagtatggaaaggggagaaaagtaactttccaatggagacatcttagccaggtgttcaagtcagcatcagtagtggtgaatcatgttgattgtatgtactcttgacatgatgtgatgacaatggcactttacctctgtgctcttcctcccaaaagcccatggccctgtctaatcatgagacatcagacagatcccaaccgagggatattctacaaaatattcgaccaatactcctcaaaaatttcaagaccatcaaaaacaagaaaagcctaagaaactgtcacagccaagaagggcctaaggagacatgatggctaaatgtcatgtgggttcttggatgggaccttggaacagaaaaagaatgttaggaaaaaactaaagtagtctgaataaagtatggactttagttaatagtaatgtctcaacattgattaattgtgacaaatttgcgatgctaatgtgagatgttaataattgggggaaatgggtgtggagtatatgggaaactctctgtaccatctttgcaatttctctatatatctaaagctattctaaaatttaaaagttttctcagcggctgtttagcttaatcggttaaagcatggtgctgataaaattttaaagtttattataaagaaaaaacattgatccatggaatccacccccggtcccctcaggggttcaaatttaactagtccagaatttggccttggctttgggctattataggcagccagggttaagaaccataccttcagtgttaatcaaagccgtctgaaaagttagcatattcttgccttatccctttttctcacacacctcaaactattcttttggttccatgaaaaaaatgttgttttataattttctttctttctttttttttttttttgagatggaatcttgctctgttgcccaggctggagtacagtggtgcaatcttggctcactgcaacttccacctcctgggttcaagcgtttctcctacctcagcctcctgagtagctgggattacaggcatgtgccatcacgcctggctgatttttgtatttttagtagacacggggtttcgccatgttggccaggctggtctcgaacttctgacctcaagtgatgcacccaccttggcctcccaaagtgatgagattacaggcgaaagccactacgcctggcctgtgttattattttcttgaatagcgttatgggttgacttttgagtctcccacaaagatatgttggagtcctaacccccaattccttaaaatgtgacctcatttggagataggggctttgtagatgatcaagttaaatgaggtccttagggtaagccataatccaatgtgaaaagtgtccttataaaaaggtgaaatttgatacagagacagacagacatgtgtccaggggagacaatgtaaagacagggacaaatcatctacaccatcagggagagaggcctggaccagacccttctctcacagccctcaggaagggcctgtcgacaccttgatttcgtacgtctagctctgggaatgtgacaataaatttctgttgtttgagccactcaatttgttacaccattcccttcaagactaatacatatagtatttgcattcttctggaatatgttatggcttcataaacatacataaatatagacatgatttcaagggatcaaattatgcataataacattatagtatcaattttcctttcgtatgatgcagtcctttgtggaaggacatgtgaatggtttctctaaactgtgacctcctcaagggcagctctgcatctccatggccagcattatgtaacactgtggttccagcctcaggagcagaagcagggaagggtggtggcttggagctctggtgatggaaggagggctcccttctgtatgtgcaagcccagggcttttttggtgggaagcatggtctcaaagggagtggagtgaccacctggagaaataagagatggactgttacatattgcagattgacaaagaaggccatactggttttatgtaattttctctctctttccacaattaatatacagctgtttttggcaacagctttattgatatctaatttacataccatatattttacttgcttaacgactacaatttggccaggtgtggtggctcacgcctgtaatcccagcactttggaagcagaggtgggcggatcgcttgagccgaggagctccagaccagcctgggcagcatggcaaaactgtctctacaaaaaatataaaaattagccaaatatggtggtggtgtgcacatgtagtcccagctacttgagaggctgaggtggcaggatcacttaaacccagaaggtcgaggctatggtaaggtgtaatcataccattgcactttagcctaggcaacagagtgagaccctgtctcaaaaaaaaaaaaaaaaaagaaaaagaaaaagaaaaaagagcacaattccatggtttttagtattaatatattcacagagttgtgcaaccatcaccacaattttagaatatttgcatcacagcagaaagaaatccatacccatttccaatcacctctcatttccaatctccctagccctgggaaaccactaattttttttttttttttttttttttgagatggagtctcactctgtcgcccaggctggagtgcagtggcaccatcttggctcactgaaacctccatctcctgggctccagtgattctgctgtctcagcctccctagtagctgggattacaggcatgcaccaccacaccaggctaatttgtttgtatttttagtagagatggggtttcaccatgttggccaggctggtctcaaactcctgacctcaagtgatccacctgccttggcccctcaaagtgccgggattacaggtgggagacactgcacccggccagaaacaactaatctattatttgtttctatagatttgtctgtttgggacatttcatgtaactagaatcatacagaatgtggttctttgcgattggcttctttcaggcagcatgatgttttcaaggtccatccatgtggtagcaggtatcagtgcttcatttctttttactgccaaaaaatattaaattgacttgtatacaccacactttatttatccattcacctttgaattgtttcaaagttttgactatcatgaataatgttgtcatgtacatttcatatacaagtttctgtgtggacatatgtttttatttctcttgggtgcatacttaggagtagaattgctggctcatatgttaactctttgttaacatacagaaactgtcagactgtgttttcaaaacagtgcaccattttgtattcctaccattagtgtatgagggttctactttttccatatcctcaccaacaattgttattatctgcctttttgattataaccaacgtagtgagtgtgaagtggtatttcattgtggttttgatttgtgtttctctgatggctaattctataacattttataatcagaataaaataagttctattctaaaaaatagcaacgacagcaattcttctttaggtaagacattgtctgtgttccagttttctctgacaatctgtgacccagtagtctcacagacagtccttttggataaacatagaaatttacccctctggtcttaaacttatatttgttttatctgagttccttcttcaggaaaggacacccaggactctcaaaaactatcaaagaactggctgtctgcggtggctcatgcctgtaatcccagcactttgggaggccaaggcgggcgaatcacgaggtcaggagatcgagaccatcctcgccaacacagtgaaaccccatctctactaaaaatacaaagaattatctgggcttggtggcagacacctgtagtcccagctactcaggaggctgaggcaggagaatgtcatgaacccgggaggcagagcttgcagtgagccgagatcacgccactgcactccagcctgggtgacagagtgagactccatctcaaaaaaaaaaaaaaaaagtttcaaagaactgaaactcaccagatgatccccacatccagaaagtgagatgatctcatgcgtcattaatcatgattgctttcttactcctccctagttcctgttttcccacacattgctaaatttcttccctgccatataaacctctaattttaattggtcagggaaatggatttgagactgacctcccatctccttggctgtagcacccgattaaagccttcttccttggcaatactcatcatctcagtcattggctttctgtagggggagcagcaggacctaaactaaaccctgctgtttcggtaacagattttggttccctgaccaggaacacattgctcatggtttggctgctgcaggccaggaatctcagaagccatcctaagcagctgcccacccaattttgtctggaggtgagttttggtctccctctggccctgctgctgaccccaactgtgttcctgattgcctagaaagagcatcctttgaaatttgacatctgcatccacatgggatagtgtcctttgtgggtcctgatagcaggatctgctcctctcaatttgggaaatatttatagaaatttccatttgcaggttgaacaagcccaactgacttgagagaagcaccctgactgtttcagtgtagacattcttgggggcttgtttgtaattgtgtgttttgtgtgtgtgtgtgtgtgtgtgtgtgtgtgtatgtgtgtgtgtccaggcaagtgagtgtcttgcaggtaccacacagcaggattggatcctctcaatttgaaaaatttcaaaggaattttatttgcaggttgatcaagcccaaccaatagagagaggaagcaccccaaatgtttcagcttggacactcttggggcttgtttattgctgtagcatttgaattgtgttttggtgattgtgtgtgtgccatgggaaatcagaattcaataaactgaaattcttttgtaatactgtttgaccccaatattgtttggaatctggagtttgctgttgaatgggaaagtgggatggagttctgtgtatccaggcttttgtgctgctgttctaagcagagttgggcctggttatttatttatttatttttgagatggagtctcgctgtgttacccaggctggagtgcagtagtgtgatctcagctcactgcaacctccacttcatgagttcaagtgattctcctgcctcagcctcctgagtagctgggattacagttgcgctccaccacacctggcttattttttttttttttgagacggagtctcgctctgtcgcccaggctggagtgcagtggcgcaatctcagctcactgcaagctccgcctcctgggttcacaccattcttctgcctcagcctcccgagtagctgggactacaggcgcctgccaccatgcctggctaattttttgtattttcagtagagacggggtttcactgtgttagccaggatggtctcgaactcctgacctcaagtgatccacccgcctcggcctcccaaagtgctgggattacaggcgtgagccactgtgcccggcctacacctggcttatttttgtatttttagtagagatggggtttcaccatgttggtcaggctagtctcaaactcctgacctcgtgatccactcatctcagcctcccacagtgctgggaatacaggtgtgagccaccacgcccagccttgggcctggttatcatgcgatgttctcccatggtgctgtttggcttcagtgttctttggagtctggagaggtttggcctttaaaaaacaaattgccatggaaactgctttacccacaattttggttcacagccttcactggattgcctatccagtcaaacaaagtgtagccacataaactggtgatttgtattgctatcttatggctacagttcaaaggcaaaggctattgtatctttgtttatatatgtgtgtatacatgtctatatatgtttatgtatgtacgttatatgttgtgtctaccaaattggcttataaatacaaaaaactcatatattaagtccaaagtctttttcaagttcacaagacttacataaacctttaataaagaagctggctttaaaattactgataaaataaaagtagaagggtcttcagaattgtcagcatacatttttgtctaggttttatatttgtctctgctagatgttttgaggtgtcagggtttggcacagaaggttataaaactgaacccagctggaataaacaaaataatcttcgtttgtgtgccttctttgacaaaagagatcaatttaatgttgttagctgaatcttctgagttattggcaaaaaatacttatgtatttaactttaagtttcttacttagatcctggctatttaaaaaaatggttagctggatgcggtggcttacacttgtaatcctagcactttgggaggctgaggtgggcagatcacgaggtcaggagttcgagaccagcctggccaacacagtgaagccccatctttaaaaaaaaatacaaaaattagctgggcatggtggcagtggcctgtaatcccagatacttgggaggctgaggcaggagaatcacttaaacccaggaggtggaggttgcacttcagcctgggtgacagagctagactctatctcaaaaaaataaaaataaaaaataaaaaatggaaattactttgattgatgactagttgtgtcttatatctcagttttcagaagtaatctagatgaacttaaaaaatgaaatgattgagtacatgtaaatgggatacatgttataggtaaacattttgtataatttaaaatcttaaaattatttttgatgcttattggatatctgattcatttccaattaataaatggttatgatatgggaaaaaataattttacaaattgtggattagttctcatctatcaaatgctgatatctgataagcagctcaggatttcctacttcctaggttttttcactaaaatttaaggttactaagaataagaattctagttaatatataattctgtatataaagtgtgccaaaaaagatgtgtttttattgagaaaaagaatcattttgtctggttcagaagttatctaaaggttaattcaaattatgggtttgaaaatgttatttatgaaacaaggtagaaagtaaccagtaagtacaggagagagatgtgaacaaagttatggatatgaagatgtatttttggtataggttctaaagaaaagattccaaagaaaatagaataattatgtatgaaaaaggatcttgtatggcaaatttttgtcctaaagtaaaatgactggttatttaaaaaaaaaaacaaaaaaacaaaacagaaagaaaaagggaaaatgtagaacaaaacagaaagtccaagcatgtcacagatggtctgtgtaagtcatacgttgtctgtgtgtctctcttcatgcaaatattctttaaaacctgatagaaaattggagaaatttggctaattaacattgcttatagttaaatcttgtagtcttgatgaaggtaaaataagaaatataggaaatattgtaaagaaatacattggtagtttggcaattttaaaaaatatagttaagcatgaagccagatttagcgtagaaccacatctcacatacatgcttgcattgattcacactacatttgctgttctgcagatagggctagcactaaagtataatactggtcatgtactgagaatgaatttctgttctttgttattttttttttctgtgagacggagtctcactctgtcacctaggctggagtgcagtggcaagatctcagatcactgcaacctctgcctctgtgattcatgtgattctcctgcctcagcatcccaagtagctgggattataggagcacaccaccatgcctggctaatttttgtattttcagtagagatggggttttaccatgttggctaggctggtctcaaatgcctgcctgggcctcccaaagtgctgggattacaggcgtcagccactgcacctgacctaaagtgaatttcctaattgcacaaaatgtatggtagtattggtggccttaaagacattaaattgcatatcaggaagaaaatattcgtcatgcgatttttttttttttttttttttttggctctgagtaacactgtagcctccaaggtaaactgagtataagaaaaattttgggttggtttcctgtttatttcttttgcttctaatttttatttgctgtttgtttgcttttgggttttacttatacatacatatatataaaatgattgactttttaaaattctagtggaaggcttttatttggttctatgaacaatcattttgtttcctatgcatttccagcaattcaccatttgccctgtttatcctaagctacctttgtcaagcctccaaaaattgatagaggatactagccatttaaaatttgaggccagtccagcacagcacagcgcggcccgcaggagcctggcctgaacatgtgcccaccagacctccaaacttgagccaccatctctgcccatccctagggagcctaagcccctgcagcacccctcccacctgtctccagccatgggtgatgttgatgctgctgttttggagacaacactctaagcatgtgtgcttccaattgtgagtctgtgaactctgtaaagagacagaaaatcgattcccaggcaagatgggcgaataggaacagctctggtctgcagttcccaacgagaccaacatggaaggtgggtgattcctgcatttccaactgaggtactcagctcatctcactgggactggttagaacgtgggagcagcgcatggagggcaagcagaatcagggtgaggtatttcctcacccagaaagtgcaaggggttggggaactccctcccatagccaagggaagctgtgagtgagggatggtgttacttggcccagatactatgcttttcccactctcttcacaactcacagaccaggagattcccttgggtacctacaccaccagggccctgggtttcaagcacaaaactgggtggccatttgggcagacactgagctagctgcaggagttttgtttcgtatcccaatggtgtgtggaatgccagtgagacagaactgttcactcccctgaagagggggctgaagccaggaagctgagtggtcttgctcagcggatctcaccctcacagagcccaacaagctaagatccactggcttgaaattcttgctgccagcacagcagtctgaagtcgacctgggatgctcgagcttggtgggggtagggatgtccaccattattgaagctcgagtaggtggttttcccctcacagtgtaaacaaagcctccaggaagtttggactgggcagagcccaccacaatgccacaaagtcactgtagccagactgcctctatagattcctcatctctgggcagggcatctctgaaagaaatgccgcagccttagtcaggggcttatagataaaatccccatctccctgggacagagcacctgggggaaggggcagctgtgcgtgcagcttcagcagacttaaatgttcctgcctgccagctctgaaaaaagcagcagatcacttgacacagtgctcaagctcctgctgagggacagactgcctcctcaagtgagtccctgacccccgtgcttcttgatggggggacacctcccagcaggggttgagagacacctcatacaggagagctctggctgccatctggcaggtgcccctctgggacaaagcttccagaggcagaagcaggcagcaatctttgctgttttgcagcctccgctggtgatacccaggcaaacagggtctggagtggacctccggcaaactccaaaaaacctgcagaagaggggcctgactgttagaaggaaaactaataaagagaaagcaatagcatcaacatcaacaaaaaggatgaccacacaaaaaccccatccaaaggtcaccaacatcaaagacgaaaggtagataaatccgtgaagataaggaaaaaccagtgcaaaaagactgaaaattccaaaaaccagaatgtctcttctccttcaaaggatcacaacttctcaccagcaagggaacaaaagtggatggagaatgagtctgaggaagtgacagaagtaggcttcagaaggtgggtaataacaaactcctctgagctaaaggagcatgttctaacccaatgctaagaaccttgctaggaagctaagaaccttgataaaaggttacaggaactactaactagaataatcaatttatgggctaggcacagtggctcacgcctgtaattctagcacttagggaggctgaggtgggtggatcatgaggtcaggagttcgagatcagcctaaccaacacgatgaaaccctgtccctactaaaaatacaaaaattagctgggtgtggtggcacgtgcctgtagtcccacctactcaggaggctgaggcaggagaattgcttgaacccaggaggcggaggttgcagtgaaccaagatcttgccactgcactccagcctgtgtgacagagcaagactccatctcaaaaaaataaataaataaaaatagaataaccagtttagagaagaacataaatgacctgatggagctgaaaaacacagcatgagaacttcgtgaagcatacacaagtatcaatagccaaatcgatcaagcagaagaaaggatatcagagattgaagatcaacttaatgaaataaagcatgaagacaagattagagaaaaaagaatgaaaaagaatgaacaaagtctccaagaaatatggggctatatgaaaagaccaaacctatgtttgattggtgtactgaaagtgatggggagaatggaaccaagttggaaaacacacttcaggatattatccaggagaaattccccaacctagcaagacaggccaatgttcaaattgaggaaatacagagaacaccacaaagatactccttgagaagagcaaccccaagacacataattgtcagattcaccaaggttgaaatgaaggaaaaaatgttaagggcagccagagagaaaggttgggttacacacaaagggaagcccatcagactaatagtggatctctctgcagaaaccctagaagtgagaagagagtgagggccaacactgaacatttttaaagaaaagaattttcaacccagaatttcatatccagccaaactaagcttcataagtgaaggagaaataaaatcctttacagagaagcaaatgctgagggattttatcaccaccaggcctgcctcacaagagctcctgaaggaagcacgaaatatggaaaggaaaaaccagtaccagccactccaaaaacataccaaaatgtaaaggccatcaacactgtgaagaaactgcatcaactaatgggcaaaataacaagctggcaacataatgacaggatcaaattcacacaaaacaatattaaccttaaatgtaaactggctaaatgccccaattaaaagacacagactgacaaattggataaagagtcaagacctatcaatgtgctgtattcaggagacccatctcatgtgcaaagacacacataggctcaaaataaagggatggaggaagatttaccgagcaaatagaaagcaaaaaaaaaaaaaaaaaaaaagcaggattgcaatcctagtctctgataaaacagactttaaaccaacaaagatcaaaaaagacaaagaagggcattacataacggtaaagggatcaatgcaacaagaagagctaactatcctaaatatgtatgcacccaatacaggagcacccagattcataaagcaagttcttagagacctgcaaagagacttagactcccacacaataatagtgggagactctaacactccaccgtcaatattagacagatcaatgagacagaaaattaacaaggatattcaggacttgaactcagctctggaccaagcagacctaatagacatctacagaactctccaccccaaatcaacagactatacattcttctcagcaccacatagcacttattctaaaattcaccacataatttgaagtgaagtactcttcagcaaatgcaaaagtacagaaatcataacaaacaatctctcagaccacagtgcaatcaaattagaactcaggattaagaaactaactcaaaactgcacaaatacatggaaactgaacaagctgctcctgaatgactactgggtatataatgaaattaaggcagaaataaataagttctttgaaactaatgagaaaaaagacacaatgtaccagaatctctgggacacagctaaaacagtgtttagaggaaaatttatagcactaaatgcccacaggagaaagtaggaaggatctaaaatggacaccctaacatcacaatgaaaagaactagagaagcaagagaaaacaaattcaaaagctagcagaagatgagaaataactcagatcagagcagaactgaaggagatagagacacaaaaaacccttcaaaaaatcgatgaatccaggaactggttttttgaaaagattaacaaaatagatagaccgctagccagactaataaagaagaaaacagagaagaatcaaatagacacaataaaaactgataaaggggatgtcaccactgatcccacagaaatacaaactaccgtcaaagaatactataaacacctctatgcaaataaactagaaaatctagaaatggataaattcctagacccatacaccctcccaagactaaaccaggaagaagttgaatccctgaatagactaataacaagttctgaaattgaggctgtaattaatagcctaccaaccaaaaaaagcccaggaccagacagattcacagccaaattctaccagaggtacaaagaggagctggcaccattccttctgtaactattccaaacagtagaaaaagagggactcctccctaactcattttatgaggccagcatcttcctcatatcaaaacctggcagagacacaacaaaaaaagaaaatttcaggccaatatccctgatgaacatcaattagaaaatcctcaatgaaatactgccaaactgaatccagcagcacattaaaaagcttatccaccacaatgaagtcggcttcatccctgggatgcaagcctggttcaacatatactaatcaatatatataatccatcacataaacagaaccaatgacaaaaaccacatgattatctcaatagatgcagaaaagacctttgataaaattcaacaccccttcatgctaaaaactcaataaactaggtattgatggaacgtatctcaaaataataagagctatttaagacaaactcacagccaatatcatactgaatgggcaaaagctggaagcattctttttgaaaactggcacaagacaagatcactcctattcaacgtagtactgggagttctggccagggcaatcaggcaagagaaagaaagaaattgtattcaaataggaagagagggagtcaaattatctctgtttgcagatgacatgattgtatatttagaaaagcccatcgtctcagcccaaaatctccttaagctgataagcaacttcagcaaagtctcaggatacaaaatcaatgtgcaaaagtcacaagcattcctatacaccaataacagacaaacagagagccaaatcatgagtgaactcccattcacaattgctacaaagagaataaaatatctaggaatacaacttacaagggatgtgaaggacctcttcaagaagaactacaaaccactgctcaaggaaataagagaggacacaaacaaatgggaaaacattccatgctcatggataggaagaatcaatatagtgacaatggccatactgcccaaagtaatctatagattcaatgctagtcccatcaagctgccattgactttcttcacagaattagaaaaatctactttaaatttcatatggaatcaaacagagcccataaaggcaaggcaatcctaagcaaaaagaacaaagctggaggcatcatgctacctgacttcaaactatgctacaaggctacaggaaccaaaacagcatggtactggtaccaaaacggatatatagaccaatggaacagaacagaggcctcaaaaataacactacacatctacactcatctgatctttgacaaacctgacaaaaacaagcaatggggaaaggattccctatttaataaatggtatcgggaaaactggctagccatatgcagaaaactgaaacaccttatacaaaaattaactcgagatggattaaatatttaaacataagacctaaaaccataaaagccctagaagaaaacctaggcaataccattcaggacatgggcaaagacttcatgactaaaacgccaaaagcaatgggaacaaaagccaaaactgacaaatgggatctaattaaactaaagagcttctgcacagcaaaataaactatcatcagagtgaacaggcaacctacagaatgggagaaaagttttgcaatctatccatctgacaaagggctaatatacagaatctacaaggaatgtaaacaaatttacaagaaaaaaaccaaacaatcccatcaaaaagtggatgaaggatatgaacagacacttttcaaaagaagacatttaggcagccaacaaacgtgaaaaaaagctcataatcactggtcattagagaaacgcaaatcaaaatcacaatgagataccatctcacgccagttagaatggcgatcattaaaaagtcaggaaacaacagatgctggaaaggatgtggagaaatgggaacgcttttacactgttggtgggagtgtaaactagttcagccattgtggaagatggtgtggtgattcctcaaggatctagaaccagaaataccatttgaaccagcaatcccattactgggtatatacccaaaggattataaatcattctattataaagacacatgcacacatatgtttattgcagcactattcaaaatagcaaagacttggaacccacccaaatgcccatcaatgatagactggataaagaaaacgtggcacatacacaccatggaatactttgcagccataatgagttcatgtcctttgcagggacatggatgaacctggaaaccatcattctcagcaaactaacacaggaacagaaaaccaaacaccgcatgttctcattcataagtgggagtcgaacagtaagaacatatagggacagggaggagattttcacacactggggcctgttgggggatggggggcaaggggaggggaatatcacacactggggcctgttggggcatggggggcaaggggagggaaagcattaggggaaatacctaatgtagatgatgggttgatgggtatagcaagccaccacggcacatgtatacctatgtaacaaacctgcatattctgcacatgtatcccagaatttaaagtataaaaacatttttttgattggctttgctgatgatcttgagatctatgagagccttaagtttcttggcaaataaataaataaataaaagacattttttataaggtttgaacagatagtacatttattttgttgtttgaaaagataggtgagaattaaaatgtttaaatggtgtttatttccaaggtgattcttttcattattattactattattattattattattagagatattgtcttgcttagtctcccaggctgaactggactgcagtggtgcaatctcagctcattgcgacttgccctctcaggttcaatcgattctcgtgcctcagcctcttgagtagctgggattacaggcgtgcaccaccatgccctctaatttttttatttttagtagggacgaggttttgccatgttggccaggctggtcttgaactcctgacctcaaatggtccacctgctttggcctcccaaagtgctgagattacacgcatgagccaccatgtccagcctatttccaaggtaattcaatgaaatcaataatttgagttggtttcagatctttttctttaatgaggaaaaactgtgatatgggtacaaaattttaatgctcaggaaaaattggccttgtccttacggaaattatattgattgagatttctttcaaactactttaattgtgtttactattattaacattaagtgccgggcgcggtggctcacgcctgtaatcccagcactttgggaggccgaggtgggtggatcacctgaggtcaggagttcgagaccagcctgaccaaaatggcccgtctctactaaaaacacaaaaattagctgggcgtggtagcagacgcctgcaatcccagctactcaggaggccgaggcaggagagtcacttggacccgggaggtggaggttgcagtgaggcgagattgcgccattgcactccagcctgggtgacagagccatactccatctcagaaaaaaaaaaaaagacacagggccagaaattaaaactactcaatccctctaggctgagggactactgcagaagaggtaggcacatgagattgtaatggccggttttgagggataagattagttcagggccaggtgccatggctcatgcctcaatcccagcactttgggaggctgaggtgggtggatcacaaggtcaggagatcaataccatcctggctaacaccatgaaaccccatctctactaaaaatacaaaaaaattagccgggcgtggtggcaggcacctgtggtcccagctactcgggaggctgaggcaggagaatggcatgaatctgggaggcagagcttgcagtgagccaagatcatgccactgcactccagcctgggtgacagagcgagactctgtctcaaaaaaaaaaaaaagaaagattatttcagtttttctataaattaaacattaacaccaaaaccacactgatgcaaggccagcatctgggacttcctggagcattaatctgctccttaatagaaaattgtaaaagattataaaaagtttatggaaatcttaccttatggtcaaactgattacaattggatagatttgtttataaggttttattaaaattagttttaacattaataatataccatataaaggtaaaatttggtttcccttgaacaaaatgttcatgtaagagataagagatttttgagtaaaactacagaaaaagagagggttctttccctcctagttggcttcatgctgtttttattagggcttattgtttgggaagctgagtctcctcactatcaaagggtaacctgttttgtattatcatttttgctaaacgaatggctattttatagtgacctataatcctattttgtgatgtcaagtgtcttaaaactgatctctgacaaactttccaatggcaaaatttcaagctctaaattcagtctttttgacctcaaagtaacttttttgggtataagtttccctgacgtccaagagagacatattaggtttatttggcttatttgttatgttagaattatgcaggaagcattgtcaatctgaggtggtgttcagcttcctttgggttttatttatttatttatttattatttattttttagatgggtcttgctctgttgcccaggctggagtgcagtggcacaatctcagctcactgcagcctctgcctcccagattcaagtgatttttgtgcctcaggcttccaagtagctgggattacaggcatgtatcaccatgcccagctaatttttgtatttttagtggagataaggtttcgccatgttggccaggctggtcttgaactcctgacctcaggtgatccacctgccttggcctcctggagttccaggatgatatgagagttctaaaattctgatatgtcttaatatatgttgtcacagtaattattattatgatgttaacttgtatgccacaggaataacaaaataccctagttaactgtgcctttaactatggctgtcttaaaacttttgtcatccacaattgtagttttgctttgatccttctcaaaaagtgacttataatcagctacagtccagggctttcttctttggggaagtttatgaaaaattcaacctctcaaatgcaggtttcttataactttgtagactgtgccattggattagagagaaaacttccagggcactaattgaaatgctgatatgttcataaagattgctaactcaatatgaagcataccagaagttgattgcatggactgaattaatggagactgaaataattttttatggtttttttgtttgaaatattgctgattctttttgttttgtttttcagagtctggagaatttttttctttggagctttttattgcctctgagtatactttaagtatattgaatacagtatgctttcctcaaacagaatttgaggcatagttctctctatgcctaatttatccagaatttgtaaattatttgtgaatattcttaattcatggcaatgtgtttgcttgcataagttcaataagaatctattttattttatactgcgacacagatggatgaactggctattttcccaggtctttgactgaaatggccttgtgagaggttccagcaaggccaatttaggagagcctatgtggacagcaattcttgctgcactttgtggggtaatcaagccacgtttatgggattgcagcttatttcgcaggtaggtttgtcttgctgagatttgtctttggtggaagtaggggactggaaaaagaaagattgtttcagaagaaaaggatagtattagattaacctttgattcctggggggccacagagtcacccatggtatgaggctgcccaggatgcccctcatcaatatcaagcagccagaatgatcaacaagattccccatgaatgaggaattgatatttatgtatatactatattattctttttttaagatggggtctcactctatcacccaggctggaatgctgtggtgccatcttggctcagtgtaacctctgcctcctggtccaagtgattctcctgcctcagccccctgagtagctgggactacaggtgtgcaccaccatgcctgactaattttgtgtttttaatagagttgtggtttcagtatattggccaggctggtcttgaaatcctgacctcaagtgatctggctgcctcagcctcccaaagtgctgggattacaatcgtgagtcaccgcacccagcctatttaaaaaaaaaaaaaccaagaaactgtaaaccatttaaatttagcagtggagggttttataccaactttagtgacactaaatgttagtaagttctgataacccactatcattggaccaaactgtactataatttttgtcattattttagagtgtactgttagaagttaaccgtaaaacagcctcaggcaggtccttcaggaggtgtccaaaaaagggcattgttatcacaggaggtgacagctccatgcctgttattgcccctgaagaccctccagtgggacaagatgtggagatggaagacagtgatattgatgatcctgaccctgtgtaggctgaggctaatgtgtgtgtctatgtcttggttttttaacaaaaaactattaaaacgtaaaaacaagaaaaatttaatagaaaaaagcttataaaataaggatacaaagaagacatttttgtacagctgtacaatatgtttgtgttgtaagtgaagtgttattacaaaaaagtaaaaaagattaaaaaagtttaaacatttataaagttaaaaagttacagtaagctaaggttaatttattattgaagaaaacaactttaattaattagtgtagcttaagcgtgcagtgcttgtgaagtctgcagtagtgtatagtagtgccctaggccttcacattcactcaccacttactaactcacccacagcaatttccaatcttgcaagctccatttatttatggtaagtactctatacaagcagatcttttaaaaaacattttatactatatttttacagtatcttttctatgggcctgtaaggcctgtgggttctcgcgtcccccagctccccccgcagccggctcctcagtggtccgctccggttgccaggtgcggattctgttcctaactgaaggctgagtgttcttcgccattaactgtggccccgacaggcctgggttactgcggccaccgccacagcagccttggcgctatggaggagcccggggctacccctcagccttactgggggctggtcctggaggagccacgcagggttgtggcagcactgcctgaaggcaggagaccagattcgaatccttatggatttccatgggaattggtgatatgtgcagctgtccttggatttgttgctgttccctttttcttgtggagaagttttagatcggttaggagtcggctttatgtgggaagagagaaagagcttgctgtagcgctttctggactaattgaagaaaaatgtagactacttgaaaaatttagccttgttcaaaaagagtatgaaggctatgaagcagagtcacctttagaggatgccagctttgagaaggaggcaacagaagcacaaagtttggaggcaaactgtgaaaagctgaacaggtccaattctgaactggagcatgaaatactctgtctagaaaaggagttaaaagaagataaatctaaacattctgaacaagatgaggtgatggcggatatttccaaaaggatacagtctctagaagatgagtcaaaatccctaaaatcactgctagctgaagccaaaatgaccttcaagagatttcaaatgaatgaagaacaaatgaagatagcaatacaagatgctttgaatgaaaattctcaacttcaggaaagccagaaacagcttttgcaagaagctgaagtatggaaagaacaagtgagtgaacttaataaacagaaaataacatttgaagactccaaagtacacgcagaacaagttctaaatgataaagaaaatcacatcgagactctgactgaacgcttgctaaagatcaaagatcgggctgctatgctggaagaagacataacagatgatgaaaacttggaattagaaatgaacagtgaatcggaagatggtgcttacttagataatcctccaaaaggagctttgaagaaactgattcatactgctaagttaaatgcttctttaacaaccttagaaggagtaagaaaccaaatctatattcagttatctgaagttgataaaaccaaggaagagcttagagagcatattaaaaatcttcagacggaacaagcatctttgcagtcagaaaacacatattttgaaagtgagaatcagaagcttcaacagaaacttaaggtaatgactgaattatatcaagaaaatgaaatgaaactctacaggaaattaatagtagaggaaaataaccggctagagaaagagaaattttctaaagtagacgaaatgatcagccatgccactgaggagctggagacctacagaaagcgagccaaatatcttgaagaagaacttgagagaactattcatttttatcaagggaagattatataccatgagaaaaaagcacatgataattgtttggcagcacagaccgctgaaagaaacctcaatgatttaaggaaagaaaatgctcacaacagacaaaaattaattgaaacagactttaaaattaaatttttagaaaaagatccttatgcacttgatgttccaaacacagcatttggcagagagcattcctcatatggtccctcaccattgggtcggccttcatctgaaacgagagcttttctctatcctccaactttgtcggagggtccactcagactctcacctttccctccagggggaggaggaagaggcccaagaggcccagggaatcctctggaccaccagattaccagtgaaagaggagaatcaagctgtaataggtttactgatcctcacaaggctccttctgacactgggcccctgtcacctccgtgggaacaggaccgtaggatgatgtttcctccaccaggacaatcatatcctgattcagctcttcctccacaaaggcaagacagattttattctaattgtgctagacgctctggaccagcagaactcagaagttttaatatgccttctttggataaaatggatgggtcagtgcattcagaaatggaattcagtggaaatgataccaaagataatcttggtaatttaaatgtgcctgattcatctctccccgctgaaagtgaagcaactggccctggctttgttcctccacctcttgctccaatcagaggtccgttgtttccagtggatacgaggggcccgttcatgagaagaggacctcctttccctccacctcctccaggaaccatgtttggagcttctccagattattttccaccaagggatgtcccaggtccaccacgtgctccatttgcaatgagaaatgtctgtccactgaggggttttcctccttaccttcccccaagacctggattttccccccctacccgcacattctgaaggtagagtgagttccctttagggttgagtctgccttcaaatgagcctgctgctgaagatccagaaccatggcaagaaacttgacaatatttttgctctcttcaaaagtcattttgactattctcattttcagttgaagtaactgttgttacttcagtgattacacttttgctcatattcaaacttaatggaattataattctcaggatagtattttgtaaataaagatgatttaaatatgaatcttatgagtaaattatttccatatcattttattctagatagtataactattttaatttgtttaactaatccactattatataaacaacagtgggagatttatagatgtaatcttgcaggtggggaggctttacatttgaaaggccatggcattatgccaagaactgtatttactgtggttgtagacaaatgtgaaagtaactttatgcttaattaaataaattttacttgattaaaaaatatatataggttgcattattcttcaggtatggagagaccaacagatcaagtgtcgattaccactgaaaaaatggtttgttactcacagatcccaacagaagggaaagtactatgccatgcagcactgaatagggaggcagtatggtcagcgagaaggcaggagtgatggaaaaacatgggcaagagcctttacagtggcttccatgggaaggaatgagtgaggcaaggtgagcagggttaaggttagctattataatttgagtaatttcagcaggctctgggtataagggctgtccctagttgtctggtacctggccctggggcgcttagggcagaggaatgtggcctagagtgtgtgagtcctgtggaagcctgatgaaataggtgactgggggcatgagctctggactggttagcttgtgtgtgaaaagcacgctcatgggcagattgtttactgtctctaggaattggctaaccctggtagggacaggcctgccaaggtcagcaaggccctagatgtcgaagtgtcagaatacataaaaagacatggttaatatggtatcagagcctctgtcttcacatggcctctcatgaagggctctagaatgagctcccttaggggatgtcaaaggccattcaagacagcagaagccacaaggccacgtaaagcttcagtaatatctaaaagaagatattaagagtaatatctcccctagatattacaaatcatattatcaaagaatgtacacccccgtgatattggagaaatacctcccttagaaattacaaagaatttcatcacaaggtgtaccctcactgtgatattaggagtaatatctcccttatatattatgaataatatcattacggggtgtatacccactgtgatattaggaataatatctcccttagatattatgaaagggaccaagaaaccttctatttcattgtttgctgtgcctagcatccattctgtagatcactccgttgttcaagtggctgctgaggctgtagccattaccttctcattttggtcataagaagatggaagctaggaagaaagtacacatccaaccctttaaagatagttcctggaaattacacatatcacatctgctcacatcctgtgggccagaagaaataaataacatagtatatctagctgcaagtgaggctgaaaaatatcattattccctataaccacgtggtcagctaaaaacaaaaaattgcattactaaagaagagtaaaacagaacagatattgaaagataacaagcagtctctgacgcagcatctaagaataattattccttttcctgatatcctgagcactaagatctagctcaaagttcagccttcactttgacagccattagagaaagtaaatgcacttcataaactagggaaatgagaattaatgaatctcagggttcccctccgccctttttttggagacggattctcattctgtcacccatgctggagtgcagtggagctgcgatcttggctcctgaaacctccacctctggagttcaagcgattctcctgcctcgacctcctgagtagctaggattacaggtgtgtgccaccacacccagctaatttgtgtatttttagtaaagacagggtttcactgtgttggccaggctggtctcgaactcctgacctcaagtgatctggccaccttggcctcccaaagtgctgggattacaggggattacagggggagccaccacacccggcctttttttccctttgtaaaaaccctcttcattaatactaagagtgttcttgaaagctacagagaaataaatctccctttcagtgaattgataaggccctggttatttcctctttacttcacaagattttttttttttttgagaccggattttgctctgttgcccagactggagtgcagtgggacaatcattgctcactgcagccttgacatcctggactcaagcagtcctcctgcctcagcctccccagtagctggaatgacaggcacagtccacaacacctggctaatttttaatgtttaattttttgttgttgttatagatacagggtctcaccacgttgtccaggctagtctcaaactcctgggctcaagacatcctcccacctcagcctcccaaactgctgggattagaggcttgagtcatcatgcctggcgcacttcacaagatttaagacattgtctcagattctcaacatctcctggaccttggccacagcctcctatttgttttcttgtctctgctctctccctactccaaaccattgcctacccttccgctggagttactaaatctgcctatgtaaaactctcctttggttcctagaggataaaggattacttccttagcctacatatgagaccctccactgtgggtcccagcctcctttcacccctgcccctgcctaccgctcactgttccctggccaggcctgtgcttgtgcacattgcttcctctgcctggaatgtgcgtctctttaggttgagactatcctgtttatctctgaaaaactggttctattcctcccccatcccaagaaagaacaggtaattgttccctctgctatgttcccattacactttctttgtagagtcacactgtaatgatctcttcacagatctcttgtcctgatcactctgtaagctcctcagaggcaaagaacatcatgtcttaccaagttacctacataccaagggctgtctggtgcctgacgcaaacagaacagaatgaagtagaggctcagcaaaagctagtggtcggccaggagtggtggcccatgtctgtaatctcagcactgtggaaggtcaaggtgggtggatcacctgaggtcaggagttcgagaacagcctggtcagcatggtgaaaccccacgtctactaaaaatacaaaaattagctaggcgtggtgttgggtgtatgtaataccagctcctcgggaggctgaggcaggagaattgcctgaacccagaaggtggaggttgcagtgatcctagatctcatcactgcactccagcctgggtgacaaggtgaaattccatctcaaaaaaaaaaaaaaaaaaaaaagctggtggtcagatcgatggaaacaaattcatgaaaatgtttccttcaacctgagaaagctgattaataaaagaaaaacatgtaaaataaaataaaatgtttctgtctggcaatgatcagaatcatatttgcttttcttttcttttcttttttttttttttttgagtttctctcttgtcgcccaggctgatgtgcaatggtgcaatctcggctcactgccacctccgcctcccggaggcaattctcctgcctcagcctcccgagtagctgggtaggtgctcaccaccacacctggctaatttttgtagttttagtagagaaggggttccaccatgttggctaggctggtctcaaactcctgacttcaggtgatccacccccctgggcctccaaaaatgctgggattacagacatgagccactgcgcctggtgcatatttgcttttcttaactaggttgcacttaatacctattatagtcaacagactgagttgaagtcttaagagacacatcaaacattcacttattcactcagaggggccagatttggtgccagacctctagtgaggaggccactagagtaacctgggggagaaatgggtggctcagccactagaaccaactaagaagaccacaattattaaaattttaattatttatttagaaacagggtcttgctatgttgcctgtgctggagtgcggtggctattcacaggcatgatcatagctcactaagcctcaaactcctgggttcaagccatcctccagcctcagcctctcaagtagctgggaccacaggtgcatgccactatgcctggcttaaaagaccacaacgttttagagctatcttctagtggtacatctgcagttttacctttagtaacagtgccacattcttcttcattctagaccactgcattctgagccatcagtataaacatttatttccctgaatgagatgaagccaaagacctactgccttaataatggacagacagtggaacagagcatgaaatagctgtttgtcctgaaaagggttttttttttttttaggaaacagcagagactgtaaagatgctgaagcctctgtccctcttccctggagaccaacaaccttcatttccagtctcagttcctgtgctgttcacacggatggtccagtgatgatctggttcccatccatccagcctatgaatcagggaggaaaatgaacagtggtactgattgagggaagctttcttgaggttttctgtttccttatgaagtatctggatgacaagcttcccttcaatgcattctcaggggcttggtctttacccagagcagaggctgagaaaattattaagatttctgaagcagtctgtcccaccctaacacatcacaaatgcgagcatttgaagaacaagagccacatgcagttatttatttatttatttatttatttatttatttatttacttacttatgacagagcctggctatgttgcccaggctagagtgcagtgatgcaatcttacctcatctctgcctctggggctcaagttatcctctcacttcagcctccggagtagctggtactacaggtgcacaccacaatgctcgactaattttttgtagagacaaggtttttccctgttgcccaggctggactcaaacctctgggctgaagcaatcctcccgccttggcctcccagagtcgggggattacaggcttctgcacccagccgccttctctttttgttaataaactctttgctgtgcacagctgagagtggggactcaataaatgtcaacagaggattgtgtttttacagacagatggacgtggaagaatccagaaacactggtgttactatggtttatttagtttgctggattccaacaccaaatgagagaggtattctattgtagaaaaacagaaatcctattggatataaatttaatgaaaatctcgagaactattcagaaacaaccaaataaaaccatacttaagagtatgtgggctaggtgtggtggctcacacctgtaatcccagcatgttggaggccgaggcaggtggatcacctgaggttgggagttggagaccagcctgacgaacatggagaaacctcgtctctaaaaatacaaaattagccgggcgtggtgacccatacctgtattcccagctactctggaggctgaggcaggagaatcacttgaaccctggaggaggaggttgcagtgagccaagattgcacattgcactccagcctgggtaacaagagcaaaactccatctcaaaaaaaaaaaaaaaagattatatgaagtttaaaacttcatacctttaagtaagattataatgttcttataacatattagccagctgaagcggctcacacctatatcccaacactttggaaggctgaggcaggaggatcgcttgagcccaggagttggagaatagactgagcagcaacatagggagacacacactctataatcttttttttttttttttgagatggactttcactcttgttgcccaggctggagtgcaacggcgtgatctcggctcaccgcaaactccacccccggattcaagtgattctccagcctcacactcacaagtagctgggattacaggtgcccgccacaatgcctggctttttgtatttttgtatgttttttttttttttgagacagagtctggctctgtcacccaagctagagtgcagtggcatgagcttggctcactgcaacctccgcctcctgggttcaagcgatgcttctgcctcggcctcttgagtagctgggattacaggcatgcgccaccacacccagctaactttttagtagagacggggtttcaccatgttgatcaggctggtcttgaactcctgacctcgagatccactcccctcggcctcccaaagcgctggaattacaggcgtgggccaatgcgcccagcccacattttgtatttttagtagagacagggtttcaccatgttggcccggctggtctcgaactcctgacctcaattgatccacaccacttggcctcccaaagggctgggattgcaggcgtgagctaacatgtaccaactacaaaattgttttttttacttgttaggtgtggtggtgagcccctcctgtgcatacaccctgtgatatattattcgtaatatctaaaagattttactcctaatatcacagtgggtgtataccagtgatattattcataatatctaagggagatgatactactcctaatatcacagtgggtgtacaccctgtgatattattcataatatctaaaagaagatattactcctattatcactgtgggtgtacactctgtgatatgattcataatatctaaaagaagatattgctcctaataccacggtgagtgtacacactgcgatactatttgtaatatctaaaagaagatattatttgtaatacctagaagaagacattgcttttaataccacggtaggtgtacaccctgtgatactatttgtaatatctaaaagatattatttataatacctagaagtagacattactcctaatatcacagtgggtgtatactctgtgatattattcatagtagctaagggagctattactcctaatttcacagtggctgtacaccctgtgatattttttataatatacaagggaaatattactctagcatcacagtgggtgtacaccctacgatgtacaccctatgatgtttcttttttttttttttttttgagactgagtctcactctgtcacccaggctggtgtgcagtggtgtgatctcagctcactgcaatctccgcctcccaggttcatgccattctcctgcctcagcctcccgagtagctgggactacaggtgcctgccaccacgcctggctaatttttttgtatttttagtagagacagggtttcaccgtgttagctaggatggtctcaatctcccaacttcgtgatccgcctgccttggccccccaaagtgctgggattaaggtgtgagccactgtgcccggcctaagtgtgatatttcttttaatgtcacagtgggtggacagtctgtgatattattcgtaatatctaagggagatacaacttctaatgtcacagtgggtgtacaccctgtgatattattcgcaatatccaagggagatattactcctaatgtcatagtaggtgtacaccctttaatatttttaggaatattcaagttagatattattcgtaatgtcacagtgggtgtacaccctgtgatattattcataatatccaagggagatattaggactaatatcacagtggttgtacaccctgtgatattttcaaaatatccaagggagatgttactcctaatatcacagtgcatttataccctgtgatcttattcttaatatccaagattgatattactcctaatatcacagtgtgggtacacccagtgatattattcataatatccaagggggatattactgctaatatcacagtgggtgtacaccctgtgatattattgctaatatctatgggagatattactccttttatcacagtgtgtgtgtataccctgtgtgtacatcctgtgatattattcgtaatacctaaaagatattgctaaaagcactccttgtggtttgcgcatgttgagatgaaaatgagatggaggtcatgatctttttaagggtggaaaagcatgaacacaaagtatcatttcataaagccaattgcagcatctctgtccatggggcttcaggggaagagatgaaacctttgttgagattctaccatgtgggtcaggcagggacacagagttatttatgggacagcccttgtcttagttggtgagaggaggaaaaaggagcaaaaacctgaaaggggatgtgcagggccaggatgcgagtgggggtcgcattccagtaatagctaagtctgggcaagggggaggaccaggctgtgagatggtggtggatggaggggtacaaggggaatggctctgaaggatgtattggtagatgtaaaagaaggtgtccaggggtctggccttgctggaggacttcgggggatggtagcagcagcataaataacatagaagcatcaaataggagactaagacttcaaaagtcaatcaagaagtacagaggggaaagtgcaatttagggctagatcatggaatgaggagatgggccaaatgctggggatggggggatatcattgtagaaagggctgagatggctttggagggagttcccctaacccaaaggttctctaaagaaagtgggagtgatttaaaatacacttgaaggaaactataaaactgcctgagaaataaaagaagacccaagatttcaaaaaatcctgggtcagatgtggtggctcacctctgtatcctagcactttgggaggctgaggagggacgatcgcttgagcccaggagttcgagaccaacctgggcaacagagtaagacccctcctccctgtgaaaaaatacaaaaatgtgtctgggcgtggtggcaactgcctgtggtcccagctactcaggaggctgaagtgggagaatcacctgagcctgggaggttgaggctgcagtgagctgagattgtgccactgcactccagcctgggtgacaaagtgagaacctgtctcaaaaaagataacagaagattgggtgcggtggtgtgtgcctgtagttccagctacttgggaagagagctgagtggggagaattgcttgagcccaagagttcatggctgtagtgtgctatgatggtgcctatgaatagcctactgcactccagcctgggcaacatagtgagacctccatctatacagaataaaagataggagaagggtaggcctagaaatgccgcatagtggaacagttaataagagtctctgttggaggccacctgggtttgaatttttattctgccacttctgccatctgaactgggacagtttctccatctataaaatgggggtgattgttcccatcttataaagtcatttgaatattaaatgagccaatgtgtgtgaggttcttaaaacaacgtctggcatgtagttaatgctcaattttattttcttttgtggtctctttgaaatgcagaagcaagttacagtattatgcctataactaacattcagttattttccttcctacattcattagataagtatttgacaaagtgttgcacagccccttgttctaagaaaaagagttcttggattatgtgttgtggtgatgttgcacgtatacactctctcttggttagcagactggcttttggaagtcccacagtaaatacaggtaactgttgacctcctgagctagtgttctataaaacacactttgaggaaacactgtgttgtataaatctagatcagagaaaaggttaaacgacagatcatctcaaaatctcaaataggtctctttttttttcttttttaagagtcctcgtctcactgtcatccaggctggagtgcagtggtgtcatgaccacagctcactgcatgcagcctctaactcctagggtcaagcgaccctcctgcctcagccttctgagtagctaggactataggcatccaacatcatgcccaagtacttttttgtaaattttttttttttgagacacagtctcgctctgtcgcccaggctggagtgcagtggcgccatctcagctcactgcaagatctgcctcctgggttcacgccattctcctgcctcagcctcctgagtagctgggactacaggcgcccaccaccacgccaggctaatttttttgtattttttagaagagacggggtttcaccgtgttagccaggatggtcttgatctcctgacctcgtgatccgcccgcctccgcctcccaaagtgttgggattacaggcctgagccactgcgcccggccaattttttgtacattttttaagagatgggatttcgctatgttgcccaggctggtctcaaactcctggcctcaagtgatcctcctgcctcaatcttcagagttgctgggattaacaggtgtgagccatcatgcctggctctattcaaatgggccatatttttatagccattaaaatagattcaagtaaaacattagtatttggagattagatgtattgtttatttcaagacacatctatcaactgaattagtagttattttgaacaatcaacatttaatgatgattgcagcaattactcaaataattaaagcaaaagtagaattttcgcaataattactgaagcaactgtgcttgactagagctgccttttgtgggctttaagtctttatggttcccttttttttttttttttttttttctgagacagagtcttgctggagtgcagtggtgcaatctcggctcactgcaacctccacctcccgggttcaagcgatgcccctgcctcagcctccagagcaggctgggactacaggcgtgcaccaccacgcctgactaattttttgtattttttagtagaggtggggtttcacgatgttggccaggatggtctcaatctcctgaccttgtgatccacccaactcggcctcccaaagtactggaattacaggcgtgagccaccacgcccggctgtaacaagccttttctaaatatcaatttagttggagaaatagtttaggaaaaaattcaagagtgccaactacaaaagatagatgtagtaaacttcattagtttcaagaattgtgaatattaagagccttggtgtggccgggcgcggtggctgacacctgtaatcccagcgctttgggaggctgaggcaggtggatcgcaaggtcaggagattgagaccatcctggctaacatggtgaaaccctgtgtctactaaaaatacaaaaatttagccgggtgtggtggcgggcgcctgtagtcccagctactcgggaggctgaggcaggagaatggcatgaacccgggaggcggggcttgcagtgagccgagattgtgccactgcactccagcctgggcgactgatcaagactctgtctcaaaaaaaaaaaaaaacaaaaacaaacaaacaaacaaaacccagagccttggtgtatgtagtccaatctaattacaggaatagaacacaaacacaaaaaaaacaaatgttttctcactatctgcccttagggccacacctccttgtctccatgtaaccagggatgatggtgggtgaataattaactgctgtttattggtgctaatgaagaacagtcacataaataatacaggctcttagactccaggtcagtattcccatcctggtcaccccagtgccaggtaccagacaaatagggacacaaccactatgtcccagagcctgagaaattatttaagcaagtgaatcctaaattggcttaccttgtcttgcctgtggaaaccacaacaaagactcgtggccatgctttctcctcgcctctctgcctcttgatggatcccagcgcttgctcgtggcattgcatggtgtggcatgccccagctcttggaaactgtgagttacaaactactttttcaagggcagtcatctcctgatctgttagcttcaccatatgctatagcttgaatgtgatccccacagttcatgtgctggaaacttgatcctttgtggtagtgttgggagttggagcctaatgggaggtgtttgggtcatgcgggcatggccctcataaacagattaatgctgttaccttgggagtggatttgccccatcttgctttctcttttccctttcaccatgtgatgatgctttccaccatgggatgacacagcaagaaggccctcagcaaatgctggcatctttatcttggacttcccagcctccagacatgtgagatacaaacttccatatattatatattacctcatctgtggtattgtgttctagcagcccaaaatggactaagacatgatacctgaataagaataaaccctacatttttaaaaacagcctgttagaacaattcaagggaccggaagtttgcattatgttgcaaggcaacagtttcagcagtgaactgatggcaaagttctttaccatcttaagctgaaaatggcttcccggtacatttcaataattctcagcctccagggcaatagagaatgaatctattcatgtttttcaagcaatgaactatcagatatctgaatacataacggtctttcctcagatacctttacaagaagcacacacatcaatctatggatttctttgaacattttttccactcttattcctataataattagcattttgcaagtcattttgacttcagttacccagtgaattgagtgttttcttccaacattctcaggtttttcaaagattatttattcattcattcatagatcaattaagcagaccctcagcagtcacatagccttcactggtttatcagtgtcttttttttttttttttttttttttttgtgagacagagtttcgctctgtcagcccagactggagtgtagtggcaccatctcggctcactgcaagctccgcctcctgggttcacaccattctcctgcctcagcctctcgagtagctgggactacaggcacccgcccccacgcccggctaatttttttgtatttttagtagagatggggtttcaccgtgttagccaggatggtctcgatctcctgacctcgtgatccacctgccttggcctcccaaagtgctgggattacaggcgtgagccaccgtgcccggccatcagtgtctttcttaaaatgtggtgtatgccaggctcggagactcacacatgtaatcccagcactttgggaggccaaggtgggtggatcacttgaggccgggagtttgagtccagtctggccaacatggtgaaaccccgcctctactaaaaatacaaaaaaataaaattagctgggtatggtggtgcatgcctgtaatcccagctactccggatgctgaggcaggagtattgcttgaacctgggaggtggtgtttgcagtgaaccgagatcaaaccactgcactccagcctgggagacagagtgagactccatctgaaaaaaataaaaacattaaaacgtggatttactattactggcttaccacacagggcttcactggcactattcccttcccgatctagagactgggtatattctattgcttggcatgccattgacaaacatgtctgggtccttccttctaaataaatcaccatgaaacagattgtatcctataactaagcaattatacagttgcttttttttttttttttgagacggagttttgctcttgttgcccaggctggagtccaatgatgcaatcttgtctcaccgcaatctccccctttcaggttcaagcgattctcctgcctcagcctcccgagtagctgggattacaggcgtgtgccaccacgcctggctaattttgtatttttagtagagacagggtttctccatgttggtcaagctgatctcgaactcccgacctcaggtgatttgcctgtctcggcctcccaaagtggctggcttacaggcgtgagccacagcgcatggccactaccgtagctttttgaatttttagttatggatgtaaaattcaccatcgttaagtatacaggcctcattacagcatgcttctttccttttacttaaaaaaagttttaaaactcaagaacccccaaattttttttttgtcctgctctgttgcctaggctggagtgcaggggtgccatcatggcttagtgcagttttgaccaccagggttcaagtgactcttccacctcagcctcccgagtagctggaactacagatgtgttccaccatgcccagctaattaaaaaacatttttttttttttttgtagagacagggtgcagcgatgttgcccaggctggtcttgaactcctgggctcctgcctcggcctcccaaagtgctgggtttacaggtgtgagctaatacatgttaactgtagaaaaatgatcagataaatatgaaagagctagttctctgtattcttattcccaagatataatattttggtatacattacttcatacgttttcctctgcgtaaagctctagtttttttaatggataaaattacacatacaaatgttttaacaacttgcttttctcaattattaatatatattggatagtctagagccatacttaagaatgaattacaattatcagcagagttccttgagggcagggactatcttttttttttttgaggcagagtcttggtctgtcgcccaggctgttgtgcagtggtgcaatcttggctcactgcatgactcactgcaagctccacctcccaggttcacaccattctcctgcctcagcctcctgagtagctgggactacaggcacatgccaccatgcctggctaaatttttttttggtttttttttttttgtatttttagtagagatgggatttcactgtgttcgccaggatggtcttgatcttctgacctcgtgatcctcccgcctcggcctcccaaagtgctgcgattacaggcgtgagccaccgtgcccagccttagggcagggactatcttaagtacagtcatgtaccacttggtgtttcagtcaacaatggactgcatatatgacaaatatcccataagattatagtggagctgaaaaattcctgttgcctagtgatatcagagtcatcatgacatcttagtgtaacatgttactcatgtttgtggcgatgctggtataaacaaacctactgcactgccagtcatataaaagtataaacacacagttatgtatagtacataatacttgataatgatagtacataattatgttactgatttatgtatatactctattattctttttttaagacggggtcttgctttatcgcccaggctggaatcaagtggcgctatctcggctcactgcaacccctgcctcccggttcaagtgattcttctgcatcagtctcctgagtagctgggattataggtgcgtgccaccaggcccgactaatttttgtatttttagtagagatgtggtttcagcatattggccagactggtcttgaaatcctgacctcaagtgatgtgcctgcctcggcctcccaaagtgctgggatgacaggcgtgagccactgcacccagcctgttttattccaaaaaaaatttaagccattcaaatttagcagtggggggttgtatacgaactttagtgacactaaatgttaataagttctgataacccactaccattggaccaacctgtactataattttttgtcattagagtgtactcctacttacatatatataaaaagttaattgtaaaacagcatcaggcaggtccttcaggaggtgtccaaaagagggcgttgttactataggcggcgacagctccatgcctgttatcgcccctgaagaccttccagtgggacaagatgtggaggtggaaggcagtgatattgatgatcctgaccctttgtaggcctaggctaatgtgtgtgtttatgtcttggtttttaataaaaaagtattaaagagtaaaaaataaaaaaattaaaagaagcttataaaataaggatataaagaaaatatttttgtacagctatacaatgtgtttgtgttgtaaatgaagcgttaatacaaaagaataaaaacgttaaaaaagtttaaacttttttttttttttttttttttgagagtgagtctctctctgttgccaggctggagtgcagtggcgcgatctcagctcactgcaacctctgccttccaggttcaagcaattcttctgcctcaacctcctgagtagctgggactacaggtgcctgccaccatgctcggctaatttttttgtatttttagtagagacggggtttcaccatgttggccaggatggtctcgatctcttgacctcgtgatccgcccgcctcggcctcccaaagtgctgggactacaggcgtgagccaccacacctggccccagtttaaatgtttataaagtaaaaaagttagagtaagctaaggttaatttattattgaagaaaaaattttaattaattagtccagcttaagtgtgcagtgcttataaagactgtagtagtgtacagcaatgtcctagatcttcacattcactccccacttactcactgactcacccagagcaatttccagtcttgcaagctccatttatttatggtaagtactctatacaagcatatattttaaaaaatcttttatactatatttttactgtatcttttctatgtttggatacacaaatacttgtggttgtgtttcagttgtgcacagcaggccatacagtgacgtgctgcacaggtttgtagaccaggagcaatgggttatgccacatagcttaggtgtgtaggaggctgtaggtgtgtaggtgtgtaccatctaggtttgtgtaagttcactctatgatgttcctacaatgaagaaattgcctaacgtgcatttctcggaaactatcctcatcattaagcaacataactgtatttatgaaacacaacacataggtgattcaattgttaaatgactgtattataatgattcctccgagactacaggtcacacatttcaaccaataatgggacaacttttcctttaaatttctgtagaactcttaagatggatggtgtgattcatttaaatcactgattacatctaacattattctgtgttcatattcactatttactttaataatttggtcccaaatattttaaaagagcaagttagaagacagtctcatatctgacacagtaaatggaagaatactagttaattgattctactattgtttccactcatccatatgaacagcccagtccgctcccaacagtgtctccctgccaggttgcattaataatgcaaattaatataagtagtagttgattatattccatttacgagtactatgcttggttatgcctgcatatagaaaaattccagtttggattacagattcttttctcacaactctttcagtgttattgtattatctaaaataaattattgatttaatgtctcttaccacgttcaagatttcacttacatctccagctatgcttttggtcactatctagacttacattaagtaaacataaagtaaaaagatgtgagcaaaacaccatgcatttgtctttgttaatgatttagaaaagccttaattcaaattataattttataccatttttaacccataatagtttgtaatccaagttacaacatagcccagtaattttgcctgatgagccaaaggcagttaaaaaccaaattctttttctggtttttaatatgtaaactgattgttcataaaattttcatcgtttcacatatttaacctatctcccaaagtttaaatcactaaaataacatggaaaatatatcattgattaattttcagtctgagtatgaaaaactaccctagtatggacaaatggacttttgcaataagcagaatcaagacagtgaacaatgcctcgttgagccaggaaaaaatgcaagtctttgcatgttaaaatacaagaatgttttatgtcctatctacatttatatttatctatcattatatatttaaggtatgggtattatactgtattagtatcattctattggcttaacaaaaggttttatttaaaaagttctcttagtcaatgtatttttttttttttttttttgagacagagtcttgctctgtcgtccaggctggagtgcagtggcgccatcttggctcactgcaagctccgcctcccaggttcacgccattcttctgcctcagcctcccaagtagctgggactacaggcgcccgccaccacgcccagctattttttttgtatttttttagtagagacggggtttcaccatgttagccagatggtctcgatctcatgacctcatgatccgcccgcctcggcctcccaaagtgctgggattacaggtgtgagccaccacgcccggcccaatgtactttttaaaatagactttatttatttattgagatggagtctcactctgtcacccaggctggagtgcagtggcacaatctcagctcactgcaatctgtgcctctcggtttcaagtgattctcgtgcctcagcctcccgagcagctgggatacaggtgcctgccacctctcctggctaatttttgtattttttagtagagatggggttttgctatgttggccaggctggtctcaaactcctgacctcaggtgatccacccgcctcggcctcccaaagtgttgggattacaggcgtgagccaccacttccggtcaacttagttttttagaacagtttgtatttatagaaaaagagaagacagcattgagttcccatatataaactctcctagtttctcctgttaacatcttacgttagtatggttcatttgttacaattcatgaatgatataatgatacattattaactaaagttcatggtttattcagatttccttagttttcacctaatgttcttctgctccagcatcctatccagttaccacattacacttgtcatgtcctcttaagctcctcctgggtgtggcagtttccctgactttccatgttttggtgaccctgaaagttttgagtagcatcattaagtgtttcataggatgcccctctgaatttgtctgatttctcatgattagactaaggttatgggttgtggaaggacggccagctcaatgtaattttcttaagataaatttgatatgtatggagataaaaacacacctagatttcaccaaactgttgtcatggacataaacttcagtatcatttttagtactatgtctctgttgtataattagaggcagaaaagaatatgatttttcaaaaggttggcttaaaaaaaaatgagaggtagaggccgggcacagtggctcatgcttgtaatcccagcactctggggggccgaggctggcggatcacgaagtcaagagatcgagaccattctggccaacatggtgaaaccccgtctctactaaaagtgtgaaaattagccaggcgtgttggcgtgcgcctgtagtcccagctacttgggaggctgaggcagaagaattgcttgaacccgggaggtggaggttgcagtgagctgagattgtgccattacactccagcctggtgatagagcgagactgtctcaaaataaaataaaattaaattaaattttaaaagaattttaaaaagaggtagataacatcataacgatagcaaacagtagtcactttaatttgctttcccaagtaagcacattctttacaaattaaaattatgatagaaagccagacaaaatgcataatacatacatagttaaatttcatataccttcagaggtagaatttgggatttatgtaaataaatgttactcaagtatatctatgttttcaaagcatattgtcacatttttgtctgcagaataaacaataaaaaaggattttgcaggattctctgagcctatgggtcaaaaatagcccatcataaatccttagaaaatttacagtaggcaaataattctctactgaatggcagttctcaaactgatttggtgggtctggtgtgggttctgagagtgtccatttttaacaagttccagtgatgctgatgttgccggtctgagaagcatcatgagaaccactttctggctgggtgtggtggcttacgcctataattccagcactttgggaggctgagggaggtggatcatgaggtcaggagtttgagaccagcctggacaacatggtgaaaccccatctctactaaaaatacaaaaattacacgggcgtggtggcgggcacctgtagtcccacctactcgggaggctgaggcaagagaatcgcttaaacctgggaagcagaggttgcagtgagccaagatcgtgccactgcactctagcctgggtgacaaggtgagactctgtctcaaaaaaaaaacgagaaaaaaaaaaaaagaaagaaaaccactttccctgatactttaccatccaggaaactacacttactaagtgcctatgatttttattttattttattttaattttttttgagacagagtctcactctgttgcctaggctggagtgcagtggggcaatctcggctcactgcaagcgccgtctcccgggttcaagccattctcctgcctcagcctccagagtagctagaactacaggcgcccgccaccacacctggctaattttttttgtatttttttagtagagccagggtttcaccatgttagccacgatggtctcgatctcctgaccttgtgatcctcccgcctcagcctcccaaagtgctgggattacaggtgtgagccaccgcgcctggcgcaagtgcctatgattattaaggtgttatatatgtattaccttatttaatcatagaatcttatgtcagtatgattgctccttttataaatgggaatctgagacttggagaggagaaaataggatgagcagcaaaactacaatttggatctctttctaattctaacactcatgttttcctgaacaatgtactgtttctagttgataaaggagggaaatgtatgcatccttgccatgctcatttgaaaacagacaacgtatctaaagatgtatagagtgattggttcaggtcacagggcgttaactaaaggacagtgattcttaagaaccaggcaaagactcagggtcatgaagaggattcacttatctctgaactgaaataatcacgggtgatgtgaatttagtgtataactaacaaaataggaagaatgtgtttaatatagtatggtatattccttaattacaattattttattattccttacagaaaacatacaaataaaagtccttaaaagaataacctcatttaaatgtaaagcatcatactattctagatgtctgccagtgtatactacattactaatcaaccactacttactctgaaattgaggtaacacagcctgaggcaacaaaatgctctgacaattactgaaacgtttatctcctttcacaaagcaaatcaaaagcaatgacattacacaacaaaataagcaatttaagttttaagaaaagcggtacatgatacagaaatagactgccaaaaatgaaattgccagtaatataaatttctctcactttgttatattgtatataaaaaaggacactaagcggcaaaattatccaactgtagatgtcaaatatttaatgaggtctaaacttcagagtgacaaaaacacccacccaactctacatctctatcaaaacaaatatattatgtaagaaagaattccctttaaatatatatgtatatatagtcatgttatactgttaattaaacccataattctatttatttaaataagaattaaataaactgcccaaatgcttattttcatttcacaaaacataaagtattttaaatcacaacttcagggtggtatactgaatacattggttccttagacagcatcaacaagcatatttttaagaatatattttcatctataggccaggtaaagttttattaaatgatgaacattttttaacagtgcagaaatacaagttttaaaaacaaatacattcagaagatttgctgttcaaataatattttttcaaaaccaggtggaggcgtatgataaaactcactgaactggcaatccaaaattgcactgtcatcaactaaaggatacaaaaagaaagaaaataaattagaagcaaatactttaatttcaatgaatacataattataaaataaaataaactgtctccataatactacaatattaataggtaagaagaataaatatatctgctgtccctgttacaaaacataatcctatgggtaaaaacagccacaacaaaaatcaaaatctatctgtcaaaaacattggaaggatatatataaaaatattattagtaattctctcaagaggatgtgaatatgggtaatttttttcttatttgcttatctgcattttctcaattttatataattaagacatattactttttaaaaaaatgtttaactttgaaaaagtatagattcacaggaagttgcaaaaatgttaagagtccagtgcaccctttgtacactttgccccagtggtaacatcttacatgactacagctcaacatccaaaccaggaaactgacattggtacactactgtgaactagactgcaggccttactcagcttctaaatgtttttaccggtatttactcaagagaaatgaatgtgtatatccaaagacatattttcaaacgttcacaatagctttatttgtaatagtcccacactggaaacaaccctaatgtccatcaactggtgaaggataaagaaattgtgatatatccacacaatgctacacttctcagcaataaaaactgatgaattattgatatatgctacagcataaatgaatcttcaaataattgtgctgagtgaaagaagccagaccaaaagaaaagaccatatgattttgttaatataatactctagaaaatatgggctaatctgtagtgacagaaagcagatcagtggttgtttggttggggctggggtagggagtggtgagtaggatataagaggcagaaggaaacctttggggtggtgaatatgttcattaccttgaccctggtgatgacaaaacaaaacatgaccgtaaagcaaagcaagtaaataatcagcactgccacccaatagtgattactccccctgggtgaggaatgcagctgtggtgcgggctgcatctgggccaagaaaatgttctatttcttgatctaagtggtaataatgtgagtgttcacttgatagctatttgttaaattgcacatataagtttaatgcacattactatatactttatatttcagcataaatgcagaaaaaaatgtaaatactggatttgacattcatgaagtcaccagtgattttaacaagggtggtttcaattagtggtgtaatggcagctgaattgggttgcagaacaaacgaacaataacaataaaggtgtcaaatgctctacccttgagctagtcaagtaatctatacaacaaaccccccaccgtgacaccagtttacctgtgtaacaaaccttcacatgtacccccgaacctaaatgttaaaaaaaaaaaagaaagaaaaacaataaagatggcagatataggttattctagaagaaatgtggccatccagggaaggggaaacacaggactagtgagggatgcatgcccaaagaagggcgtttgggatggggcttagaatgtttataagcactgaagagggaggcccatgacatgagatatcgatgaaataactgacaaagtgacgttccagatttggggagtttggaatccagactacagatagagtgtttgcaacatgcagagtaccacttctgggatgagatggaaagaaggcaggattggacctgaagagagggaagctggagttcacttgtgattgcctgttttttttgtaaggtagaaggcaaggcattttcagaggatgaatagagaatgcaagaagcacagaatgcatagacatgcacaaagaattgctgaaaattattgagagctcagattaggctagaagtcataactttgtttttttttgttttgttttgttgttttcttttttgagacagagtctcgctctgtcacccaggctggagtgcagtggcatgatctcggctcactgcaagctccgcctccccggttcacgctattctcttgcctcagcctcccaagtagctgggaccacaggcacccgccaccacacccagctaattttttgtatttttagtagagacggggtttcaccctgttagccaggatggtctcaatctcctgacctcgtgatccgcctgcctcagcctcccaaagtgctgggattacaggcgtgagctactgcgcccagccaggaagtcgtaactttgtaaccacacttcttcagtgttatgcagtctttttctttctacaggctgagtgtaagaagagacaaaatgaatgattggattgatcaaggattagggatggaagacaaaagagtaaagggatttaagttttatgtttatctttgataggatcaggctattaaaacacttggtttaattggactgatttatgagttcaatttatgaaatataatttagtatctataaccttagtacattacaaataatgctgaataaaagaaacagtttagagcattaaacttatttgctacagttaacttgtataactgtcactctactgatatttattttatttctcaggctaacctatttcaaatatcaagctaaatttccatttactcaagtaaataaaggaattgcttttaggcttacccaatatgcaacactaaattgagttttaaaacacacatttacatgcaaggacacagaaggtaaaatgactgaaaagtaattttaggagaaaagaaggctaatgaaaaccttaaactaaaaggtaatcacaagctttggctattatcatattattatttatatttgttattgtataattctgacatcccagtttgtcatcattgatactgctatttttattttagtattttaattttattttgcttttgagacagggtcttactctggtgccaaggctggagtgcagcggcacgatgatcactgctcacaggagacttgacctccccggctcaagagatcctctcagctcagcctctcaagtagctgggactacaggcacgtacaaccacacctggataattttaaaattttttgtcgagacgtgttctcactatgttgctcaaggctggtcttcaactcctggactcgagcaactcttacctcagcctcccaaagtgctgggattacaggcatgagtcattgcaccagtgctgcttttatagtaaactacaacaaatgtaattaaattagttcttttttttttttttcttttttttgagatggagtcttgctctgtcacccaggctggagcacagtggtgtgatctcggctcactgcaacctctgcctcctgggttcaagtgattctccgcctcaccctcctgagtagttgcgattacaggtgtgtgccaccacacacggtttcaccatgttggccaggctagtcttgaactccagacctcaagtgacccacctgtcttggcctcccaaactgctgggattacaggcatgagccaccgtgcctggcctaattagttatttttctttcttttttaattttattttattttatttttttttgtggagactaagtcttgctctgtcgcccaggctggagtgcaatggcatgatctcggctcactgcaacctccatctcctgggttcaagtgattttcctgtctcagcctcccatgtaactgggattacaggagtgcgctaccacgtctggctaattttttgtatttttagtagagatggggtttcaccatgttggccaggctggtctcaaactcctgacatcaagtgatccaccggcttcggcctcccaaagtgttgggattataggtgtgagccaccacgccagtcctaattagttcttattataacccaaatttaagaacttaaatgagaaaatatttttagacttacaaaaccaaaggcagaaaaatcatatacctgtttacttaaagttgataatacaaaataggctggacacggtggctcatgcctataatctcagcactttgggaggccgaggtgggcagatcacttgagctcaggagttcgagatcagcctggccaacatggtgaaaccccatctctagtaaaaatataaaagttggccaggtgctcacacctataatcccagcactttggaaggccgaggcgggcagaacagaaggtcaagagatcaagaccatcctggccaacatggtgaaaccccatctctactaaaaatacaaaaattagctgggtgtggtggtgcgtgcttgtagtcccatctactcgggaggctgaggcaggagaatcgcttgaacctgggaggcggaggtttcagtgagccaagatcgtgccactgcactccagtctggcgatggaatgagactctgtctcaaaaaaaacaaaacaatacaaaaaaaccccaaaagttagctgggtgtggtgatacacacctgtaatcccagctactctggaggctgaggcacgagaatatcttgaacccaggaggcggaggcagcagtgagccaagatcacaacactgcactccagtctgggtgacagagtgagactctgtctcaaaaaaaaaaaaaaaaaaaagttgatagtataaaaaataaagcagaatggattgataaagacattgtggttatgtttttctaaaaaaaaaaaaagaaagagacctttttttcgagatacaaataaaacatttatgaataaaattatatattacctggcatttgcctcaaaataacccaaggagggtaagtgaagaacaatagcagcattgggggtgggggggtgtagatgaaacccgattggttacaagttgataattgtttgaagctggctgatgggtatatgagggtttattatactattctttttacttctgtacatgtttggaattttctataataaaaattaaggtaggccggatgcagtggttcatgcctgtaatcccaatagtggtgcacacttgtagtcccagctactggggtggctgaggtgggaggattgcttgaacccaggagtttgaggctgcagtgagctgtgatcgggccactgcactccagcctgggggacacagcaagactctgtcgcaaaacaaaacaaaacaaaacaaaacaaaacaaaaaaacaaaaaattaaagttaaaattaaaattctaagtcactatttccctcagaagagcattaacatttaaggaattttgtaagggttattaatgtacagtctacataaaattcccatctctaattccaaaatattatttataattatgtttcctggccatgcaatcattcccaatgacttgcagaaaaagttttctaaattcagtaaagctttttgaaactttctaaaacataaaactacatgttgaaaaagggagtacggttattgcatatttaagtgtaatcattgtatttagcaagtttattttaatacatggggaacagaaactatccttaatcctgcaaagtgggattgtaatatcctaccgactacaatccatataaaaaggtccttatggctgggcacggtgacttatacctgtaatcccagcactttgggaggttgaggtgggtggatcatctgaggtcaggagtttaagaccagcctggccaacatggtgaaaccccatctctactaaaaatacaaaaagtagccaggcgtggtggcaggcacctgtaatcccagttactcgggaggctgaggcaggagaatcgcttgaacccaggaggcggaggctgcagtgagctgagatcgtgtcactgcactccagcctgggtgacagagtgacactccgtttcaaacaataaataaataaataaaataaaaaggtccttattaacaatgtgtccagatttctagatgatagctataaaagtaacatacacgctgatatggtttggctgtgtccccacccaaatctcgtcttgaattatagttcccattatccccatgtgttgtggagggacccagtgggaggtaattgaatcatgggggtggttacactcatgctgttcttgtaaaagtgagtgagttttcacaagatctgatggtttcataaggggctttccccaacttcgctcaatcttctccttcctattgccatgtgaagaaggatgtgtttgcttccccttccgccatgattgtaagtttcctgaggcctccccagctctgtggaactgtgagtcaattaaacctctttcctttataaattaccaagtcttgggtatgtctttatagcagcatgaaaacagactgatacacacaccaaacaagttaatatgtatgtaataatacattagaaatatttttgcttaccataaacaactggatacactgtccctcgtatacctgatgctggacaatgcatgttttttccattcaagtatacatttaattcgacatggtcataagtaataccctaggaaggaaaaaacagaaacgttccataaaagctgagccgtcagaaagcattgactgggaagtatggaaacacaaaaagctaagcataggctgacaacaattttcattaagggttgacaatttggtagaatcctacttgaactgagctaaaaaaatgagtagtgattatgaggggggataaagtcaggtaacatcccaagagtccacattagaggtaaaacaaagccaacagtttaaatcctagaattatatttgtataatctggattttatattttgaatgctaagataatataagtactacataccatgaatagagaaaccttttacactcatacagaaaacgctgctctttctctacagaatttgatctaaagaaggaaaaacaatgaggtttttttcactgtcaggacttactacctgtcactgttttcaaattatgaagaaacgtctctatacattttatttccaggaagaaataacacatttctacatctctttactctggtttcaaatgtgtcaagtgtattatcaaggaaaagctggtgttcacaactgaataaaattggtaattagtttcaagttaaaaaacaaaaatagtagctcaaatgatttaaaaaacaatgtaataaaattactcggtacactattgatggaaaaaaatcacaattagtgatattaataattattgttaaaataattattttataattatataaataaaatatttatttgtataaatataaattatttatataaataaataaaaggctagaaaagacttagcccatgttataaaccaatagtgctactattctaggcagttcatatttactcatttaatcctcacaacaagacagtattactatccccattttacagatgaagctaaagcacagaaagattaagtaatttacctaaggttgcacagctaggaagtggaaaagctgtgatttaaatccatacagtatggtttcagaatccttgctcttaatcacaatacctctctctaaatcaccatgcctctctttaaacacttgctcttaatcaccatatctctctttaaaactttatacaatagctactaactgataacaaaaagagatctttcccttgaaagacagcagagatctttcaatagagaagtcatcatagaccaagaagcaaaccacttcaaggatttcaggatttctgactgtggatacattctatcaagttaaaagctttttagaggtaaaaaaaaaaaattttatagatcatcttagtcttaaattctctctctttacaagcaagacagcaaaagcccagagaagctaatgtggtaagtggtatgaaagattctcaattcttagcaaagccagggttaacttaaacaattattaataattaaggaatactgagaaagataaatagtacatagattgcctttgcttcgctttagtttatgtctttagataatagtaataaagctagctgatggctgggattcacttttctaatgaaaaagtctgttttcattttaaaaaacaaaaacttaattacataaaaaagaaagtatgttactctcattatgggactaccagaaatctagcagttcagatcagtgaggttgtaatccaggcactttcatcccccagtggccgattgcaaacaaacaagtttgttttttgttttttttttgagacagagtctcgttctgtcacccaggctgtagtgcaatggcatgatcttggctcactgcaacctccacttcccaggttcaggagattctcctgccttagcctccccagtagctgggattacaggcgcccgccaccatgcctggctaatttttgcatttttagtagagatggggtttcaccatgttggccaggctggtcttgaactcctgacctcaaatgatctgcccgcctcggtctcccaaaatgcggagattacaggcgttggccaccgcgcccagcctcaaacaagcaagttttaaacccaagcctgcagtagcaaaatcccagtaccaaagaagtgaggaaagatgtgagaagtcccaccctcagtatagtttagttcaagtattttctttctttttttttttgagactgggtctcactctgtcgcccaggctggagcgcagtggcgcgaccttggctcagtgtgatacgcccgcctcagcctcccgaagtgcagggattacaggcatgtgccactgtgatgggccagttcaagtgttttctaacctaatctattctatgatgaagaaactgggtttgattctgccaaaatgatagcaaaatatactgtgtgttctatgtctttattaataattgtgtgcaggttagtgaacagattctgaaattagactgcttcaggtatgatcttggtttttgtttttgtttttgagacaaggtctttttttttttttttgaggcagagtttcgttcttgtcgcctaggctggagtgcaatggcgcaatctcggctcactgcaacctccgcctcccaggttcaagtgattctcctgcctcagcctcccgagtagctgggattacaggcatgcaccactacgcctggctaattttttgtattttttttagtagagacggggtttctccatgttggtcaggctggtctcgaactcctgacctcaggtgatctgcccacctcggcctcccaaagtgctgggattacaggcgtgagccaccgcacccggccagagacaaggtcttgctctgtgtggcccaggttgggtggagtgcagcggcaggatcacggctcactgccgcctttatctcccaggctgaagcagttctcccacctcagccttccaagtagctagaactacaggggcatgccactatgcccggctaattttctttttaaattttatttatttatttatttgtttgtttgtttgtagagatggggtctcactatgtttcccaggctggtctcaaattcctgagctcaagggatccttctgccttggcctctcaaagtgctaggattacaggcatgagccatagtatctggctgagctatatagtcttgtaattaactcacataagaagttacttaatttctcttaatctgtaaaatggggataataatactactaccgtacgggcgtggtggctcacacctgtaatctcagcactttgggaggccgaggtgggtagatcacttgaggtcaggagttccagaccagcctggccaaaatggtgaaaccctgtctctactaaaaacacaaaaaaattagctgggaatggtggcaggcacctgtaattgtagctactcaggaggctgaggcaggagaaccgcttgaacccgggaggtgaaggttgcagtaagccgagactgcatcattgcacttcagcctgggcaacaagagcaaaactccatctcaaaaaaaaaaaataaataaataataataataataataataataataataatacctatttcaaagggccattatgagcattaaacaatttaatccttgccaggcacttagagcagtgcccataataaatgcttaggtctgggcacggtggctcatgcctgtaatcccatcactttgggaggccaaggtgggtggatcacgaggtcaggagttcgagaccagcctgtccaatatggtgaaaccccgtctctactaaaaaatacaaaaattagccaggcgtggtggcacgcacttgtagtcccagctactagagaggctgagacgggagaatcgcttgaatccaggaggtggaggttgcagtgagccgagatggcaccactgcaatccagcctgggcaacagagtgagactccatctcaataaataaatgcttagaagtgtttgttattgttattattacatagaatgtttataagacttctctaaaagtaaactgatacatgcatgttagaatgaaatttgtacttttcagaattatatgtataaggagaaagtaggccgggcacggtggctcacgcctgtaatcccagcactttgggaggccgaggtgggcagatcatgaggtcaggagttggagaccatcctggctaacacagtgaaaacccgtctctagtaaaaaatgaaaaaaattagccagtcgtggtggcgggcgcctgtagtcccagctactcaggaggctgaggcaggagtatggcgtgaacccaggaggtgtagcttgcagtgagccaagatagcgccactgcactccagcctgggtgacagagcgagtggccatctgaaaacaaaaaaaaaaaaaaggagaaagtgagcataaactgtttcatgtatgtctttctagttctgtagcaggccgtgctgtactgggtgattatcatatgaatataatcatataatcatttggttagatgttcacagcttatttttcttgatttctcctcagagaatggtacatgacttaaattctaaacacatgagaatgcttttcctgtcttataatccattctacttattgcatgccactgttaacaatttggtaaaatttgttctccagtgtttgaactagttaaaatagcagggtaatgtttttcttttcttggctctgcatgtatttcatagttttagttctccttttatgagaatgagctcatatgaaaactcgaagtctaatttaacaacactgacagactaaaagtggcattcttcagtctgtcacactgtgctatcagacattacaatgaacgaaatgagataggaaggcaggtagaagtttcagttcatcaacaaagaaaaacatttgttactgattatcctttcttatgtttgaatttcatcttttagggtaaacaggttgacagcatcaacttgacttcaagattctctttcaagaaattaccatttgaataaggatgttccatattatgggcatctggcaatgatctacaaatacagaaccaactattcaaaaagcatgggaaaaagcagatttttttaatggcttatgcctttcatctcctttttttctttagtcaattctggaaaaaaaacttccaacaattaaaaacttacagttgttcatattttttaaattgcaaaaaagagaagaaagatcaggccgtaattaaaaatcttaatttccacacctttcttcattctttctaaaatactgtaccttttcataattaattaacctggatttctcttatcttttcatcttattagaatccttctctcattattcatagattcctttcaacttgatatcagaattgagaacccaaggttcagtgtacaagggcacctcggctgaaggagactctaggactctgttctaaatcaatggcctgacctctggatagggaggggttttggataatgcagtgtggaaggaagtatctggaaaagacagaaagaaatctttggattacattttcaatgtgctagctttgtaaagagttaaatatagccagttaggagtaaaaacagaaaagtcttaataacgtgtaacttttactatcctctgctttctaaaaaaaaaacttttctacgatcaagctttaggattttgagttccgttctctgaagagtttaattaggttaagtttaatgaagatgaacatttctgataaaatgctgtaattctcttaatagaatttcataacaaattaagaaatacatgtgtggctaggcgcggtggctcatgcctgtaatcccagcactttgggaggccgaggcaggtggatcacttgaggtcaggagttcgagatcagcctggccaacatggcgaaaccccgtctctactaaaaataaaaaaaatcagccaggcctggtggtgtgcgcctgtaatcctagctactcgggaggctgaggccggagaatagcttgaacctgggaggcagaggttgcagtgagccaagatcatgccactgcactacagcctaggtgacagagcgagactctaagaaaaaaaaaaaaaacaagaagaagaaataaatgtgaacattttccctaagagatatccagccttaaaaataactagtattttctaatataagcttcagcaaacttttagaattgtgggccaagttttctctaatgtgagagaaacaggaatgtgtgatcagcagacagcctgtcattaattctccagagtagaaataagggttcacactgattttcccagccagtggcagctctaaaaaggagggggcagttgagtagggtgcaacatctacaccaagtgctctcctggaaaatgcaccatctcattagatccaatcccactgctttggaattcaaaccacaaactcccagacaaagctgtagatactaaaagcagttcaaatttagtcatttacagtggaaagcaactccatgagggaactcaccaccacatctccttcctgcggaagactgtttgctggcagcctatttttctcttcattgttgtggtaaagggctccatcatttctcatcaccagactgtgcatatctcggccaagaggaatctgattcaagttaaccttctgagttgcaacaccaataccccagattcctaaaaatataacagtttaaatgccctcaaaatctgaagactacaaccatcgagttattttaaaagggagtataaactttttaaaggaagtgctgtattaacactaaattgttttctattactctttttaaaaaatcttcttttagaagtagtttgcaccagcctgggcaacatgcccaaaccccgtctctacaaaaaatacaaaaattagttgggcatgggagcatgtgcctgtaaccccagctactcaggaggctgaggtgggaggattgttggagccagggaagttgaggttgcagtgatccatgatcattccactgcactccagcctgagcgacaaagccagaccctgtctcaataaataaaataaaataaaagtagtttgcaaactatactatgttctccacagatgtagtacagcctaggagataagagagtgggccctggaacagtgcaaatgaggattaaatcttgactctgctacatcatcttgcgcaaattacctaacctctctttgttcccttatctgtgaactgaggattctaacagtactcaccttgcaaggtaatgaaaagatacaacaagataatccaagtaaagcacttgaacagtgtaagtactccacagcatgagaaagtaaagcacacagtaagtattcagaaaatgctagctgtcatcatcatcattattattatctcaaaaagattttttaaaagctacacattgaatttaaatggcctggagttcaatttcaagctctccctttgaaaagtgggaatgtactgtcttcagtttttacatctacaatgagtgacaaacaatatataccataagcaatatcatggagaggagaaattaacaataaggtgtaaaatcattttcttacccagtattttaagccaccacacccagctaatttttcttttctttgtagagatggggttgtgctatgtttgcccaggctggtctcaaactcctggccttgagcaaccctcctgcctcagtctcccaaagcgctggaattacaggtgtaagccaccatgccccattgaaaatcattatttaaaactaatttagagctaggcacggtggcttgagcctgtagtttcagctactgggaaggctgcggcaggagtactgcttcagcctagaagctcaaggctgcactgagctataatcatgccactgcactccagcctgggtgacagagcaagaccccatctataaataaataaataagtaaaaataatttagaaaataagccctagggggaaattttatatcattcaaggctggccaagtaatagtaagattcatttactccactctcattttcctattctctacccacattactgatgcagtatttcactagaagtttatttacaataaagcttgttttgtttttgtttttgtatttgtttttttgagacagagtcttgtactgttgcccaggctggagcgcagtggcacgatctcggctcactgtaacctcttcttcctgggttcaagcgattctcctgcctcagcctcccgagtagctgggattacaggcgcccaccaccacgcctgactaattttttgtacttttagtagaaacggggtttcactatgttgaccaggctggtctcaaatgcctgacctcgtgatccaccccctcggcctcccaaagtgctgggttacaggcgtgagccaccacgcccagccactttttttttttttgagacggagtctcactctgttgcccaggctgcagtgcagtggcataatctcagctcactgcagcctctgtcttccgggttcaggcaattctcctgccttagcctcccgagtaactgggactacaggtgcccaccacgatgcctggatgatttttgtatctttagtagagatggggtttcgccatgttggccaggctggtcttgaactcctgacctcaggtgatctgcccacctcggcctcccaaagtgttgggattacaggtgtgagccactatgcccgatcactttacagtaaagcttttattttaaaagttttcccatatacaatacaggcacagttaactaacctattataatcacatagaattgctttacagttcaagaaactccataaattttaaaaagagaaatatagactgcagacttctatctgaattctgaatttgatgactgcttcaaaacactgaatcagggtatcttaataactgagttaagagaaaaactctggctcatgcctgtaatcccaacactttgggaggccgacgagggcagatcacaagatcaggagtttgagatcagcctgaccaacatggtgaaacctctgtctctactgaaaatataaaaattagctgggcatggtggtgcatgcctgtaatcccagctactcaagaggctgaggcaagagaattgcttgaacccgggaggcggaggttgccgtgagtcaagaccgcgccactgcactccagcctgggtgacagagcaagactccatctcaaaaaagaaaaaaaaaaagaaaaactcagaatcaacagattgactttaatcctaaaataaatagcaagagtatatgctgcttatatgtttgaccttatatgcttgaccaaacaagagggttcatccggatcccattaaaaatactagtgccttatatttatgcagcatgtcttgtcttaaaacactttcatacatagagttcctgtgaggcagaatgggcagctcctgtaatacccattttatagatgagaaaactgaacctaatttaactaaattaactaatttacccaggatcacacaacaagaggtggaagacccagatcttctaagagtttggtgcttttatattaccttctgaatcttttttatgtgttacaaattactcttaatatttagaacaattaggacttttaatagtaaagtaccattataccaacctgtggactggattttgaattcaaaatagcttttgttttgatgtaaaggtgcgctggctaaacaacctcctgttccacatattcttcttccattctttacaataacaacatctgttcctaaacaaaaaatgcagacactatgtaaagttttgtattttcttttcttttcttttcttttttgagacggagtcttgctctgtcacccaggctggagtgcagtggcacggtcttggctcactgcaacctctgcctcctgggttcaagtgattctcctgcctcagcctcccgagtagctgggactacaggtgtgcaccaccacacctggctaaatttttatatttttagtagagatgggggtttcaccatattggtcaggctggtcttgaattcctgacctcgtgatccgcccaccttggcctcccaaagttctgggattacaggcgtgaagcaccgcgcctggccaagttttctattttcaatccaacaatcaggattaatttgttcagttctaactcagtccacaaaaaatagggacactgtaagtactttgaaatatagctgaattattttaaatatttaattcactattttttcctaagagaacatttataagtaatattcatttgtatgtataagttttaattaagcatgctgggtacagtggttcgtacctgtaatcccagcactttgggaggccgaggtgggcagactgcttgagtgcaggaagtcgagaccagcctgggcaaccttgcaaaaccccatctctataaaaaatacaaaaattagctggtgtggtggcacaagcctgtagtcccagctacttgggaggccgaggtgggaggatcacttgagcctgggaggcagaggttgcagtgaactgagattgcaccactgcactctagcctgggcgagagaagtaagttttaattaagcagtttcaagtaaactgcaataactctgaattatattgaacgttcaaaacacttttaaggtagaaatagactaactcttttaatttttagccaggaaaccaatttgatgatttcataaatttcttaatttaaaccaaaacataaacacaagagactttagtaaattggtagttttcaattctattcaaatgaattaaaacaatttactaaaagccacctgaatgcctactaaatacaagctactatacttgtgcattagtcatgtaagaactgaagagtacagggaatatgaaaaagaacacacatctatgttgaaatacctgacagtgacaaactgctaactttaggatcttaaaatgtttattaagatagctacttcaatcacattgcaaatatgtaaacaaggttttaacattcttacatgcactttattctcgtagaaaattttttagatgaaacgacatctatagatgagagtgagaaagagagacactgtctcctgatgtgatcctagtaccaatttgatttaggaaaatgtctatcagagaatatacataattctaacatgtaagaatacacagaattacataattctaatatgtaagaaatagcccatacaccaatgcataactccccatacttgtggccactaccaccactttgctggcaataactgtaccagccaagcagatctgaatattcgaactgtatgggactcttccagaaggggttaaataaaattaggtcatagtaacaaaaggttgaattaacagttaaacaaaattatttggtacaaatacataaaagaaatgcaaaattttcagattctaacacaattctaaactggttaagagatgctctcccttaaacaaggcaaaactgagatcctattgtatgattactaaaaattcattaacatctttttttttctaattaaaaaagttaacccccaaattctgggaaagtacctttataaataatttgcatctggctactccatatacctccagtaatttcaactggagagcatcctccttgatggcaaagaccatgcagtgcttggcattgagcagctgctcatcaaataactgataaaggttgaattaatatgctgtgctaagcactttgtagtggacatgcagtatctgttctccctctcccgacagacttccctctggagatcaaaacagttccaagaaagctgactcaatctctgcttcaggtgtacaacatttgatctaggttaaggcaatcagtgccctccacatttcttggccacagtaactgagtcaagaactgctacatgacctaatcaactacaatcagaatctcaggacttttgcagagcacaatgggatataacactcttggccaggcgaggtggctaacacctgtaatcccagctctttgggaggctgaggcaggcagattacttgaggtcaggagttcaagaccagcctggccaacatggtgaaacccccatctctactaaaaatacaaaaattagccaggcatggtggtgggcgcctatagtcccagctactcaggaggctgagacaggagaattaattgaacccaggaggcggaggttgcagtgagctgagatcaggccactgcactccagcctgggcgacagagcgagattccctctcaaaaaaaaaaaaaagaaaaaaaaagaaagaaagaatattcagggtgtttatgagtcattagggaatcattttaagcttatcccatttctcttaagtacacagacggttttagaatctgtacttttaatgattggtgctgcttagacggtcaaggcaaatttgagtacagccagaatgccacataaacatagccacagaggatgttttaagaaacataaatttccaaatgagcggtgtccctttcaaagtagctgccttggaagtcatttgtttctaaaatgtcgattcacaattaaaagccaaagatatggcatcaatgataatacttacaaaaattatgccatagaaaattccaaaagaggaattccaaagtggttttaagtaatacaacatcactaaaataagtgacaaccctcggagaatcacttgaagtatacagacaattttgttaaaaaaaaaaaagcaatcacattttttaggttatttaatataataatctttcacaccaccaaatccatgtgtttctattttcaagtcaagatcaattcatgcttgaaacatgttcttctaactcaacaacccttttctttcattttattcaggttctcaaatcaggctcctctgtgattgaataatttaagtttatagaaagacaggctaagaaaaaacttcctggccgggcgtggtggctcacccctataatcccagcactttgggaggctgagaggcaggcagatcacgaggtcagttcgagaccagcctgaccaacatggtgaaactctgtctctactaaaaatacaaaaattagccgggcttgatggtgggcgcctgtaatcccagctactcaagaggctgaggcagaagaattgcttgaacccgggaggcggaggttgcagtgagtggagattgtgccacagcactccagcctgggcaacaatagtgaaactccgtctcaaaaaaaaaaaaaaaaaaaaaagaaaagaagaagaaaaaacttccatgcagttagaaaatttggagatgacattactctatttcatccagttagtagctgacagttgctggacagctttggagaaataaaacacagtggaatgagtatatctgaccagctcttcctagaggaaacagatgacagagaaaaggaatgctccaaagaggagactgcagtaattcaagagtctaacagtaaagataggaagaagtgctgcagttgatcatgagttccaggaattatgtatggttgtccttcactatattctcagcacttataacaatgcctgccacctgataattgcttaataaatatcacttcagtaaatgagtaactgaaatggaaatattttctgaggaaaactatagaatttgaactccatcgtctataaataatgatggataaaaaataatttaaagattacttatgtattaaggttctgtactacatttgggagatctgagaattaaaagtaaatacacacatacaaggtgattatatagttatcacatttagtatgtgttatacaaaaatacagtgggcagagtgtttccagaattataaggaaactgggcgagagagttttatcataaatattaagaagtgcctttttatttcaatgcactgtcctttaaacaatcagaaacgtgtaaaaaatcaaaagtgcagaagtacagttagaataaaataatccacaaaaagacagtactctaactgaaataattatattgggaaatctctccttctagaaccacattccagaagcatgaaactacctgggaaaagtctaagaaataataaggtggtgaaagaggctatgatgggagaggaagaatgttagataaattatatggatttggaattaaaaggataaagcaagatgcaaaggagcaaagtgctattttatttttcaacagttagacctgttgggaagaggccagtcagatgaaattacagtacctctcacaatgactaaggagtcgggcaatgggaggttttagttgaaatggcaagttctgacctgaggtgcgacttcagacttctgcagtctgccttgtttcgactttaggaggtgagaggaaaattacttccaataatataggattcaacctataaatgatggggctcaagagacaggaccgacagtcagggcaggaggaggagcaagaccggacctagaagcattctgaaaatgtgtaggttttcactggggcgcgccagaagggcactctccgccccctcgcccgaggacgtgtgacatctccggaggaagcctccgagattcctgtgaaaatgggaggtccacacgcccattcgcgatgacagacacagagagggctgcgcagccttgaacacagaaccgggcccaggtggagtccgccggcttctggagagatctgcgagacgaaatggtgtcggcgcagcgtcgccggcgcgcagcgtggggaccctctgaccctgaaggtcccctgccccgcggcccccgtgagccgttgggtctggggaagggagggcccttacccatgtgctgcgtgtccagctgcacggccggcatctccttcagagggatgtggccagtccccccgtctctgcagcaccgcaggcagcacaacaccgaggtggccatcgcgcagggaccaccgactccgccgccgtccctagaccgaggcgacactgccccccgccgctcagctccgtctcctgcccccgcccgaggtccggacttgtctatgtggagctcggaggccggtacagcgacaccctaggccgggagggcgcaatgcaggctgagcttaggctggcctgcgaggaagacgcggagaatcaaggggccggggagagaccggacagggcgagcggccgggctgggccggggagacgggtggggctagtggcgcgcggaggcgtggcagggggcgtggcgttgcgggcctgcggatgtgggacggcgtgcgcctgcgcaccagctggttttttctccttgggcggtttcgcgcacgcccccagggctgacaggtgagtggggctgtctgtccctcagtacttccaggggttttcctatgcagaatttttaaaacgcagcaccccttggtcccggcctcgacattatttctagggatggattgacagaagcgaatcagtttgggggaaggggagctaatggaaatgacttccgagttttccctccgcgggcccaggttgagcaggctttgccaccacggagagccccagtctccctgccgtggctggtttccctcacatgctaaatagactcacgtgggccccaggagtaatgcctgttagtgactgcactgtggatgttcaccggggctcacgcgggccctaatgcattttcggtgcagagacgcgccctacctggcccatcgggctgcgtggtccggggcgcgtgggaggccgccctgggagcagaacgctggggcggggtcgggggcgattcttgacctgcctcttccaagctccccctgtctggtgcactgagggttccgaggaatgtgacgggaacccaggaggctgcgggaagtctgctgggtcccgagggaagccttcggctcctaccgtccgctactttctgcttccacacgggaggctgtcacctgtcatctccttccccacttagatcatccttccgtggtagattttacatcttcaggccgggtgcagtggctcacgcctgtaatcccagcactttgggaggctgaggtgggcggatcacctgaggtcaggagttcaagaccaggatggccaacatggtgaaaccccgtctctactaaaaatacaaaaattagctgggtgcggtggtgcacgcctgtaatcccagccactcaggaggttgtggcacgagaatcgcttaaacccgggaggcggaggttacagtgagcctagatcgcgccactgccctccagcctgggcaacagagactctgtctccaaaaaaaaaaaaaaaaaaaaaaagataccgcttggcatctggaaatgtctgggacgacctctagaattaacctagctcaaacctctgttcccagatcagtttcatcctgaaggcttccctagggatggatcatcaagtcctgggaaactggacataaaatgcccactacttaaataatgatttcccatacgtaacttttagtgacccgagttataaatgttttttaaggaggatttctatctatgcaatgaggggaatttttcaggttcctggttctctttctataaatggtgttttcattacaatactaagggaaagttttgtacgttgaaattaagttaccatagaatttaataaccaaggtgattattaaactgattgagggttggtcttttcccccattgcgtatgcagtactttcttggtaatcatttcacacaagaaattttcttttatgacaaaccttcatcgttatgctgggaattaagtgctttgatttttttttttttttttttttttaaccccagggaagtgctgggggcggggcagggggtgagaattttaacagaatattggagagacaaaatttttctaccgttcatatatatatatctagttgaattatttcaagatttcaaggtcagtattgtccccattttataggtgaagaaataggcctagaggtactaaactttacaacttcaggtgagcaggagataaacaggtaggattcaaggcttaccagtctgattcctgttagaagaaaaacttcagctgaactaaatttaaaggagttaaactgagcagtgaatgactgggcagcccccagaatcacagcagattcagagagactccagggatgcctcgtggtcagaacaaatttttagacaaaaagagggaagtgacgtacagaaatcagcagtgagatacagaaacagctgcattggttacaggggggcgtttgccttatttgaacacagtttgaacaatcagcagtgtatgactggttgaagtatggccgctgggattggccaagactcagctattgttacaggtgcatactcctaaattaggttttcaagcttgtctgcctattaacctaggttacagttcgtacacaaggactcaaatacagaagtacagagtccttctcaggccatatttagtttgctttaacactgcctctcaaattctttctcttataattaatgctataatcctcttaaacatgctctcagttcaaaatgcagatttgcccttttttgtgtgtttcatttatctccacattggatataagctgccataatgcatgtatagacaaaatataatagaattagttgttataaagtaaaaattttgttcagaaatattattaaaagaagtacatgtattatatatgtaataaacatttaggccattcaagtcagtcacatcttcaatgaaaagccagacactaaatggccgtgaattggacattactatagagaggcagaagggccatagtctttcctagctggaaaagtaatttgctggggcgctgcccggtgcactttgcccccatcctagcaactcgagtgtgctcagcagaatgaagttagcaaaactggttagctcctgaaacagacttccctgtcttggcagattaacaccatccatgagctcacttttccttctaatatctgggattctaatatccattcattattactttcaaaggaattatcctctctttttgaaaagcacaacgttaaagatgttttgacactctttcacagctatcgctttaaataacaatcacaaataaagccaaaaatagtttctcaaggtcatttatctaagtcataagcaataagaaagaatgactacttcaaaaaaagagtctgtctgcttccaagacatgccaggaactcgagaactgagaacaataatgtaaagcttgtgtttcagagttgagattagcattatgcttaagattttctttaatgttttttatgccagctggacgtcttctgttagtgaatttcccattctgtactgggtcatacgaaatgagtttttaaaaactcattaatcagttattaaacaaaacatttttccttagactaatccaaaccacatttgtgatctttttaaaaatcagaaacattaacaaaaactcatttttctaaaaactgacatatttctggagccttgaccaattcattattataattttgagtaactaatagtgattgacatttatgtagtgcttattattgccaggcactgttctaagtgttttttaaaaataaactaatttagtctttgtaacaaccatgtgagggaaaaactatcctccactttacagatgaggaagctgaagaaaaaataagaaatgtactcaaaagttgcacagtcaatgaaggatgaagctaaattcaaacagacattctggctctagggtctgtgttcttaaccactctgcaaactgcctcctagggtgttacatttaaaaatacattcctaggtctggtgcggtggttcacgcctgtaatcccagcactttgggaggccgagggatatggactgcctgagctcaggagttcgaaaccagcctgggcaacatggtgaaaccctgtctctactaaaaacaaacaaaaaaattagccgggcatggcagtgtgtgcctgtaatcccagctacttgggaggctgaggcaggagaatcgcttgaacccagaggcggaggttgcagtgaaccaagatcgtgccattgcactccagcctgggtgacagagcaagactctatctcaaaaaaaaaataaaaaaataaaaaatgaatatacattcctaatttgtatttgtctccttctatcccctttcctcagagactgacatttaaatttacttggcatgaattgtgctcatttaatctggatttcctgaattataagttatattacctagattgaacaaccaaaaataaataaggaaaataacgtcaaccttgtaactgcaacagactgccattagttggttctcttagcggtgcctttgaatattaatattttgcaggtttgtccttaacaggctgtctctaccggaaaaaaaaaacgatatttagtactttttttcttctttttctttttttgagacagggtctcactctgttgcccagactggagtgcagtggcaccaccacgcctggctaattttttgtgttttttatagagatggggtttcaccatgttgcccaggctggtcttgaactcctaggctcaagggatccactcaccttggcctcccgaagcgctgggattataggcatgagccaccctgcctggcctgtttagtactttttttttttttttgagacagagtcttactcttgtcgcccaggctggagtgcaatggtgcgatctcagttcactgcagcctctgtctcctgggatcaatcgattcttctgcctcagcctcctgagtagctgggattaccgacgcccgccaccacaaccagctaatttttgtatttttagtagaaacgcactttgggaggctgaggagggcgaatcacctgaagtcaggagtttgagaccagcctggtcaacatagtacttttaattgctaagacaggtaaaccaggttggagacttggaaaatgcagagacttggcattaggaagaaaaagaagctggggtaaaataaaggaatttgaaaaaggtacaaaagaaataaaaatagaacaatttttttaatatttaaaatgaagaaaaagcaatagcaagtgctacataaaaaaggtctcagagaatagaaaatgtgatttaccaaaaactttcaacctagaactgtaccttattctgcttaccttccatggaaaataaagcagactgtcataaaccaaggggatttctgtgatccctgcccaacctcaagttcccttactcgaaatgcaagtaccctagtgtatttctaagtacttttccttgccaatttagattctaagtactactgtggcaataattagcgaaaatagatactgaggatacaaaagggagacaaagcaaaggtcaaaaccaaagtagttttttgcattttcaaaagaaataaaggaagatgaggacaagtaaagttcgtccttggatctatgctccttattaacaggagggcatttaaacctgtgactttgtagaaagggctgatgagaagtgtgtacaaagttttcatggccaaagataaggctacataatctggtattatgggagaaaggctggagaacacttagctgtgccaaatagttcaaataaaagcttcccaaagcatctcaagcattcaagtgattctgtgtctttgaagtacagtaggggtcaaggagcaagaagtcaccatctccagattataaagtgaaaaagtactcgacatttgcagaaaggaccagacagaagaaaaaaacacttctgggtatatataatatctgcaaccaaacaaaattataaatattttgttgaaattgtgagaaagaccctaaaatatttctagtaacaaggaaggtcacatggattattaaaatgtacccaacattactaatttaggatagatacaatgccatttagtctctataattttatttttgtgaatgtaaaaatatttataaagtttttcaaaaggctccacctatagtgacaatcccttcaaacctattttctcaataatggccctgcagatgaatatccccgggactgtcagaaacctgccttttgtgttgagaaggaactgctatacttctgttaaagcaagtgtgtctatggttgtagatatggtgctggatagaattagtgtagttctggggacaactgctaagccactatgctttacagattctgtaacctgagtcatagggaacgtgggactacttaaaattgttggtgaaagtttatgaaactctggattgttcgaaaaatgctcaaaacaaaaaacaacaaaaaaaagaaacaaccctatgagagttgggtatgatagtacatgtgtgtagtcccaggtacttggaaggctgaggtgggagaatcacttgagcccaagggttcaaagctgtagtgagctatgatggcacctgtgaatagccactgcactccagcctaggcagtgtggcaagaccccatttgtaaaacaagaacaaaaacgtgaaataactttgaaataccaagagttagtgagaagaagctccagggatatgtttatggccaagagaactttagtgtagcagaatagatttgcagagaatttagtataattaaaatacttttttcttatttttagctattccaaacttttaaccaaatcctttttttttgagacagagtctcactctgtcgcccaggttggagtgcagtggcgcgattcggctcactacaagctccgcctcccgggttcacgccattctcctgcctcagcctcccgagtagctgggactataggcgcccgccaccattttttttttctatttttttttctatttttagtagacacggggtttcaccgtgttagccaggatgatctcgatctcctgacctcgtgatccgcccgcctcagcctcccaaagtgctgggattacaggcgtgagccaccgcgcccggcccaaatgctttaagaattattttacatcccttcttaagtaggtaaacttcctgtttgtagatatcatgtcttacatctaatgcagatatcagtccacatcaaacatttaatacattcttaaaaaaaatatgtgaagccttggaaaggaagagagaagttaggaagatactttaatctttccaatttcttaggaaaaaaaggaaaattccattttatatgttcttaattcaatgatgtctgctatgtagtgagcactctgtaaatatttataaaaacaacaaatgaacgaagccccccaaataagtaaatatgtttttttgttttgttttgttttttgagacggagtcttgctctgttgccaggctagagtgcagtggcccaatatcggcttgctgcaacctccgcctcccaggttcaagtgattctcccatctcagcctcttgagtagctgagactacaggtgcatgccaccacgaccagctaatttttgtatttttagtagagacggggtttcaccatgttggccaggatggtctcgatctcttgacctcgtgatccacccgccttggcctcccaaagtgctgggatcacaggcgtgagccaacacacccggtcaagtaaatacattctaattacacctcatttcatccacaacccagaaagtagtatgtaaactgaattcttagaaaaacatttccacgttaaatgcactagggcaggttgccgtataaaggaattctataaacaattttttttttaagagatagggtctcactttgtcacccaggctggagtgcagtggtacagtcataactcactgcaactttgaactcctggactcaagctgtcatcctgcctcagcctcccaagtagctgggactaaggtgcctgccaccacgcctggctaattttttaaattttttgtagagatgggggggtctcattttgttgcctaggctggtctttaactcctggcctcaagtgatcctcctgcctcagcctcccaaagtgctggaattacaggcatgagccaccgtgcccagccacagattttttaaaaataacagttttattgagatataattcacatatcatagaattcaaccttttaaagtatatgtttaatggttatagaatgaaccattggtttatagaatatcactgagttgtacaattgccatcgccccaaaaataaacttaatattactagcagctactttccattcctccctactccagcccctgaaaaccactaagttactttctgactctgtgggtttacctattctgaacatttcatataattggaattgtacagtatttggtctttttcattatctaacttctttcacttaatatgacgttttcagggttcatccatgttatagtatctattccttcctaatactttattcctttttatggttaaataatattctaccatatggatataccatattttgtttatccatatatttattgatggacatttgggttgttgctatttggcaattatgagtaatgctgcaaggtttttgagtgaacatatgttttaaattctcttcattgtatatctagaagcaaaattgctggatcgaataatgactctattgtttgaagaactgacaaactttttcaaagtggctgcgccattttacaatcccactagcaatgtacaagagttctaatttctctacattcttgtcagcacttgttatcgtctgtcttttttattttagccatcctggtaggtatgaagtgttatttcattgtctttttgatttgcatttccctattgacacacagtgctgagcatgttttcctgtgcttagtggcgatttgtatatcttttttggagcaatacctattcagatcctttgtccatttttaaattgggatatttttgtttttgttgttcttgagttgtaagagtcttgatatattctagatataagccacttatcagataaatgatttgcaaatattttctcccattccatgaggtgtttttttactttcttgcctttgaagcacaaacattaattttgacagagatttatttatctgttttttttttgtcacctgtgcttttggtacttgtgatggttagttttatgtgccaacttgactgggttaagggatgccccatagctggtaaacattatttctgggtatttctgtgagagtgtttaaatgaaagatcagcatttaaatcagttgactgagccaggcatggtggctcacacctgtaatctcagcactttgggaggctgaggcaggtggatcacttgaggccaggagttcaagaccagcctggccaacatggcgagaccctgtctctattaaaaataccaaaaaaaaaaaaaatagctggatgtggtggtggatgcctgtaatcccagcactttgggaggctgaggcaggtggatcacttgaggccaggagttcaagaccagcctggccaacatggcgagaccctgtctctactaaaaatacaaaaaaatttgctggacatggtggtgcatgcctgtaatcccagctactcgggaggctgaggcaggagaattacttgaacctgggaggtggagtttgcagtgaggtgagatcactccactgccctccagcctgggtgacatagtgagactctgtcaaaaaaaaaaaaaatcagtaaactgagaaagttgatgtgccctcacccatatgagtaggcattattcaatacattgagggctcaaatagaacaaaaaggtgagagaagagcaaattccttttcccccttctggtatgccatcatcttccctcagccatcagtgctcctgacttgggcctttgaccttggagacttacaccagcatgctccccctcctcagggctcaggccttagggcttggattagaagccacaccagtgactcccctggttctcgggttttcagactggaactgaattacaccaccagctttcctaggtctccagattgcacacagcatattgtgggacttctcagtcttcataattgagtgagccaattcccatagtaaatctcctcttatatgtctgtatgtattttattggtttttttctttggagaaccctgactaatcagtgttatatctaagaaaccattatttaatccaagattagaaagatttactcctctgttttcttctaggagttacatgcttttagttcttacagttaagtctttggtacattttgagttaatttttgcatatggtgtgaaggagttcaacttcattcttttgcacatagatatccaatcatctctgcaccagttgttgaaaggactattctttcccctgttcgattgttttgccacccttgttgaaaattatacaagactttttataacttgaattaacaaagattttgactacaaagaataatcattcttagtttaatctttgtaaatagggatagtcagaaatcataccaagattttgaaaatacctgtatggatgatttatggttggaaataccactgtgagtttttctattgactattcattttatagttacttttgtaaaagccagtagtaaagccagccaggtgcggtggctcacgcctgtaatcctagcactttgggaggccgaggcaggtagatcacgaggtcaggagatcgagaccatcctggccaatatagtgaaaccccatctctactaaatatacaaaaaattagccgggtgtggtggcacacgcctgtagtcccagctacttgggagactgaggcaggagaatggtgtgaacccaggaggcagaggttgcagtgagccgagatggtgccactgcactccagcctgggtgacagagcgagactccgtctcaaaaaaaaaaagaaaaaaattgttttatgacctcaagatctttggtttttttttttttttagtattttatttgttttaaggattcctacagagttagctaacatggtccatgttcatttcaaatgtataaatcacccacttcagtattttaagtttataaaaatctttaaatgtgtaaatcaaaaataaaattctaagaccccttcttcccccagctgtctgaatggactccctcttctcagccagagcactccaaagttagcctgaaaaactggttcaggccatgatgggaagagggggatcagacatgcatcattatgcccttctcctttttggaattcaggaaaagctgaccagcattaacatcgacacagaccttaagtctgataagaaacatttacaatctattctgaaacctgctacctggaggcttcatctgcatgataaaactttggtctccacaacctcttatgtaacccagacagttctttctattcatagtaactcttgcaaccaattgccaatcagaaaatttttttctacatgatctacatgtaactggaccccccacccttggagttgtcctgcctttctggaccgaaccagtgtatatcttaaatgtatttgattgatgtctcatgtctccctaaaatatataaaaccaagctgtgccctgatcacttgggcacgtatcatcaggacctcctgaggctgtgtgatgggtgcgtccttaacttggcaattttgagacggagtctcgctctgttgcccagactggagtgcaatggcatgatctcggctcactgcaacctctgcctcctgggttcaagcgattctcctgcctcagcctcctgagtagctgggactacaggcatgcaccaccacacctgaccaatttttgtatttttagtagagacggggttttgccatgttggccaggttggtctccaactcctgacctcaagtgatctgcccaccttggcctcccaaagtcctgggattacaggtgtaagttgccatgcctggcctgcaaaataaactttctaaaatgacagagtcctagccagagcaatcagacaagagaaagaaataaagggcatccaaattggtaaagaggaagtcaaactatcactgtttgctgatgatcgtatgcctagaaaaccctaaagactcatccaaagagctccttcagcaaagtttcaggatacaaaattaatgtacacaaatcagtagctatacaccaacagcgaccaagctgagaatcaaatcaagaactcaaccccttttataatagctgcaaaaaaatcacatacctaagaatatacttaaccaaagaggtgaaagacctctacaaggaaaactacaaaacactgctgaaagaaatcatggatgacacaaacaaatggaaacacatcccatgctcatggatgtgtggaatattgggaaaatgaccatagtgccaaaagcaatctacaaattcaatgcaattcccattaataccaccatccttcttcacagaactagaaaaaacaatcctaaaatttgtatggaaccaaaaaagagcctgcataggcaaagcaagactaagcaaaaagaacaaatctggaggcatcacattacctgatttcaaactatactataaggccatagtcaccaaaaacagcatggtactggtataaaaacaggcacataggccaggtgtgatggctcacacctgtaatcccagcactttgggaggccgaggtgggcagatcacctaggtcaggagttcgagaacagtctggccaacatggagaaaccccatctctactaaaaatataaaaaattagccaggcatggtggcacgtgcctataatctcagctactcaggaggctgagacaggagaattgcttgaacccagcaggcggtggttgcagtaagccaagatcacaccattgcactccagccggggcaacagagcaagactccgtctgaaaaaaaaaaaaacaggcacatagaccaatggaacagaatagagaacccagaaacaaagccaaatatttatagccaactgacctttggcaaagcaaacaaaaacataaagtggggaaaggacaccgtattgaacaaatgatgctgggataattggcaagccacatgtagaagaatgaaactagatcctcatctctcaccttatacaaaagtcaactcaagatagatgaaagacttaaatctaagacctgaaaccataaaaattctagaagagaatatcagaaaaacccttgtagacattgacttaggcaaagacttcatgaccaagaacccaaaagcaaatgcaacaaaaacaaagataaatagatggaacttaattaaactaaaaagcttctgtagaacaaaaataattagaagaataaatggacaacccacagaatgggagataattttcacaatctatacatccaacaaaggactaatatccagaatctacaaggaactcaaacaaatcagcaagaaaataaacaaacagtcccatcaaaaagatggatgtggtgaaaagggaacactttcacactgttggtgggaatgtaaactagtacagccactgtggaaaacagtgtggagattccttacagaactaaaagtggatctaccatttgatccagcaattccactactaggcatctacccagaggaaaagaagtcattacaagaaaaagacacttgcacatgcctgtttatagcagcacaattcacaattgcaaaaatatggaaccagcccaaatgcccatcgatcaacaactggataaagaaaatgtatatatatgcaccatagaatactactcggccataaaaaggaatgaaataatggcatttatagcaacctggatggaattggagaccattattctaagtgaaataactcaggactggaaaaccaaacattgtatgttttcactcataggtgggagctaagctatgagaatgcaaagacataaaaaatgataaaatggacttcagggactcaggggaaagggtgggagaggggtgagggataaaaggctacacattgggtacagtgtacaatgctcaggtgatgggtgaaatttaaaaatcttgaagaaaaggttattttaaaataatgtaaatttgctaattaattccatgataatatccttcactttaatgagattattctcattttctggcacttacaaaagagctcattcaacttttcaatatattgaaaagatatgtcatataattttacaatattttaacttcagtgtttaatttttcattgaaccaaaaaattctacaataatgtcaaatagtgaacaaagtcttaaaataacttcctttgacaagcttagagaagccaaatttcaaattatttttcattatcattgcacagttttgaaatctattatctattgctcatagattttttttttttcttatttaaaaattggggtaaggccgggtgcggtggctcatgcctgtaatcccagcactttgggaggccgaggcgggtagatcaccaggtcagattgagaccatcctgaccaacatggtgtaaccctgtctctactaaaatataaaaaataagctgggagtagttgcaggcatctggaatcccagctactcaggaggctgaggcaggggaatcacttgaaccagggaggtggagattgcagtgagccaagatcgtgccactgcactccagcctggcaacagagtaagactctgtcttaaaaaaaaaatcggggtaaaaaatataattattcacacctgttaggcagaataatgacccccaaagatctccacatcttaaaccacagaacctgtgaatatatggcaaaagggactttgcagaaatgattaagtcaaggatcttgagatggagagattatctcagattattcctggtgagcccaatataatcaatcacaagggtccttataagagggaggtaggatgatcagatatgtaatgatggaagcaggggttggagtgttgtggaacaaggaatgtggacagcctctagaacaagcttgtccaacctgtggcccacagactgcatgtggcccaggatggctttgaatgtggcccaacacaaatttgcaaatttgtaaactttcctaaaacattatgagattttttttttttttttttgagatggagtttcactcttgttgcccaggatggagtgcaatggtgtgatcttggctcactgcagcctctgcctcccaggttcaaacgattctcctgcctcagcctcccaagtagctgggagtacaggcatgagccatcacgcctggctaattttgtatttttagtagagatggggtttcaccattttgaccaggctggtctcgaacttctgacctcaggtgatccacccatcttggctgggcgtgatggctcattcctgtaatcccaacactttgggaggccaaggtgggtggatcacttggggttaggagttccagaccagaccgggcaacattgtgaaaccccgtctctactaaaaatacaaaaatcagctgggcatggtggtgcatgcctatagtcccagctacttgggaggctgattcaggagaatcgcttgaacctgggaggtggaggctgcagtgagctgagattgcgccactgcactccagcctggtcgacagagtgagactccatctcaaaaagaaagtaaaggaataaagaatggctaccccttagactgcagccctgagggctgctggctgcccatttttatagttatttcttgattatatgttaaacaaggggtggattattcatgcctcccctttttagaccatataggataacttccggatgttgccatggcatttgtaaactgtcatggcactggtgggagtgtagcagtgaggacgaccaaaggtcactcttgttgccaccttggtgttggtaggttttagctggcttctttactgcaacctgttttatcagcaaggcctttatgacctgtatcttgtgccgaccttctatctcatcctgtgacttagaatgcctgtctggaaatgtagtccagtaggtttcagcctcatttacccagcccctattcaagacggagttgctctggttcaaatgcctttgacacagcctctcagacccaccttagacttctaaactctagaactataatatgagaaaactgtgttgttttttgttttgtttttacatttacgggtttattataaaggatattacaaaaaatacacatgaagagataggtagggcaaggtatgcgggaaggggtgcggagcttctatggatgcacctccctggatgcaccaccctccagaaacctccagctatccagaaactcactgaaccttgtcctcttgggttgtaatggaagcttcatgacatcagcattccttcccccagggtatagggtggtactctctcatgagaaggtcttaagatctataatcagacaggttggggaacattagagtggaaggagggtgggaggtcagaggcctgcccctgagtcttaacccaccatatatgtgtgtgtgtgtgtgtatatatatacacacacacacacacacacatatataaatatatatatatatatatatattttgagatggagtcccactctgttgcccaagctggagtgcagtggcacaatcttggctcactgcaacctccacccccagggttcaagcaattctcctgcctcagcctcccaagtaactgggattataagtgcgtgccaccatgcccagctaactttgtatttttagtacagatggggtttatccatgttggccaggctggtctcgaactcttgacctcaagtgatccacctgcctcggcctcccaaagtgctgggattacaggtgtgatccaccgtgcccagccctaacccacccaatattctaacaaaaaactgtaacaagcactatgggagttggagccaggaactgtggacaaaaaccaatatatagcgtaacaccacacgccatcctctggttttcaaccatggatcctttacataaaatatatgttttattaatgattatgtatacatacatacacaatcattaataatcaatccagcccattatactgttcgaatgattcccaggatgaggccactcgggtttacaggtttcctctcaatcttgtcaggttccaaaagcagaagtggcctcggtaaatacacagcttcaccttttcaggcatctggaataattgagctacgagaaaatgtcatctcttgccctgagactcttttgacttgttaatgtgatattgaattttcctcaattaataactcatttatttatttgagagaggttctggctctgtcacataggctggagtgcagtggcatgatctctgcttactgcagcttcaacctcccaggctcaagtgatcctcccacctcagcctcctgagtagctgggaccacaggtatgcactaccatgcctggctactttttgtttttgtttttttttcctgtagagataaggtctcccagtgttgcccaggctggtcttaaactcctgggctcaagcagtcctcctgccttgatgtcccaaggtttcgggattagaggcatgagccaatgtgcccagctttatttatttatttactctcagctattatttttccttctgtccattaatacccaaaccttttcacctttggaagggacattagaatcaccactatgctggtctagattgcaggtagcaatacaagtctagcaagtatctcctcctcaatacaggtctagcaagtatctcactcccattcacatagggtaaggttacacaggtacagaactagtgagctcttttcaacaccaggcaatatagctgcattcactcttagccccaattttgctagatggggtgaaggcacaatccacccccatctgcccttagaaattttgacatagctttaaaaacataggcttttttgcctagaactcacccttgctgttctagcacttgtagttgcagctgtggtcttgggaccaccgcatcaggtaggggagagaaaaaaaaatttttttttttctttttgagacagtgtctcactctgtcgcccaggctggagtgcagtggcatcatctcggctcactgcaagctctgcctcctcggttcacgccattctcctgcctcagcctcccgagtggctgggactacaggcgcccgctaccacgcccggctaattttttgtatttttagtagagacggggtttcaccaggttagctgggatggtctcgatctcctgacctcatgatctgcctgcctcggcttcctgaagtgcggggattacaggctgagccactgtgcccggccgagaaaaaattttttgaggtgattttgagaagaaagaaaaatgtattgtcattttaccagtgtactcctttcttggtgagacctgcgtagtcatctcagcattctccccactcccttttcccagatcaaccagaaaaacagagaaaaaatctaacaggagcactctagtttcaaccacgttgagtataagccaggctttcatgcttttatcttccctggttttagacaaccaatattttaattgcccattctacttatctatcaaactattactctaaggaggatatctctctgcccattgttgggcattatgggctgtacagtgtgttcctttgtctgaagaagaaatgatggtcagccatccaaatccttgaaatatcttctgttgtttattttttttaattttttttttatggcactctgaacactttcatcttccattggataagcaaagcctgcactagagtcagtgtctattcctatcaagaattcctattccatttgtagtcccccagggctgccagcatcagtctcacttgccagctatgttcagggccttcccaccaggaaatctttcccatagccagtttctgtctctcttactgagaaacagaacagttcttcctagcattttgtgccttggaattgccatccataaaccaagaagctcttgtttggtcagttgaaagttgtttatttggcactgtagaatccagcagtttctcacacagttccagagtcagtcctaggggaaaagaaattctctgcatgccttgagtagcatgatcctctataaaccatttccattgtgtcatggaactcttctgggcactgccatccccattagaatgttcctctgacatcatctgagacagcatgcctatttcaggtatcagtggggtggcttcagtaaatgtttcattgcgagtcagtaaatgcccttcaagtggaaattctctagtccaaagtcccagtggttgttgctgggaggtgcccacaggcttttgccataagctccaggaaatgctccatagagggttatcaagtggagaatttgtccctaccagcaccgtagcttctactctgcactgtgtgggcctgggcagtctccctggttccagcttagcatgtccaaataatattgcttgaagggacgatttacatgccttctcttttacagtaccaggtagggaaaacagtcccccacacagatacaatgttcattcccatgataaaatcagataaaaaatgcaactacttcacatgaagtgttcaaatataccaactttcatagtcctatcgacccctacatttttctgttttagtttcaggaacttttcttctccacccctagaccatttaccctctcttgtgtaaaagtctttgggtacccagccaaggggtgacccaaaggaccctggccctcttgttaatctttatcttggttagtctgctcgactattgccccaggcaaattcagatcagatttttcattgtaactgctgccttttagctttttaaatttctccaaactgggagaaatacagcaaactggtttggggccctttaatgttggaggaccaaaaggggctccctttggttcacccaaccttcagggtagtgttacgttaagacctttgttttaactccatcaatttcctttttattgttgttattttttacagatgggggtctcaatatgttggccaggctagtcttgaactcctaggctcaaacgatcctcctacctcagcctcccaaattgctgggattacaggtgtgagccaccatgtgcagccaaccgcatcaatttccattttattcattccatttcttaataaccatctaaagattcctaccctgctgggaccagtcccctcttgctgccgccgctgccttctcctcctcctcctccccattcccctccccctcctccccttcctcctcctcctcctttcttgctgctgcttcttcagctgctgcttctgctgctgttgcttctgcatctgcttctgctggtgctgctgcttcttgctgctgctgctgcttctgcttcctcttcttcctcttcctcttcttcctttttcttctcctttcttctcctttgtctcatttcttctccttcttccttctcctcctcttccctcctcctccttccttcctctttcttcttctttcttctttcctctccttctccctctccttctcctccttctcctcttccagtccctccctccttccctccctccttccctctctccttccctccttcccttccttcccttcctttccttcccttccttccttctttcctttccttttttttttttttttttttctgagatggagtctcgctctgtcacctaggctggagtatagtggcatgatcatggctcactgtagcatcgaccttctgggctcaagtgatcctctcacttcagtcttcgagtagctgggaccacaggtttcttgtagtgtccaggaaccatctcttcatgttctttattgtcaatgtatcattcctgtttagtttcatgtctcccactgtgagaaacaagtagcattctgttattactcacatgccaccatggttcttcattatcttaatgtattgaaacaacatagatcttcttgccctgcatttatttaatgctgattgcatcaaaactcattaggctacatccttcatcatgctgcccaagaatactggcttctaatgactctctcacaggttatggtactgcgatcatgaccacaaacacagggtttacccagattatgcaggaaaaaaagaaaaatactttgttttcttgtcatgctaaatttattgtttgggaattttttcaagagaagaccaggtcttctcttgaactctttaaactataaactttatattcctagaacgttcctctgttgaccacatacctacctttcacacaccatcactggtagggaggattggtgagaggctctcctctttacacaaggaatgtccgttatttgaccagcagagcttaagatcaaccagggagatcatgatgtcatcaagttaataggaagcaggagaggatattgattaaaagggctgactgacattgtagaggcatggtctcaaaagccttcaagggagataggcactgccactcctgaaggattgcctgacatgaggtgcagagcctgtgtgttgtggggtgactgcattgagtgtcagtgacatgaggtacatggggtgctgtaggatacacagatccacacacatggctcaagctcaagggttgatagtgaaccacaggtagcccagagccaagagttattaaaaatcagcatgttatcaccatttgacaacccaatcttgcacaatctctggaaagaaatactgtgccaacaggagcaattcactttccaggtctcctttttggattccagctctgatttttgtatcttctcagggcatctggtccatcccaagtatgggatagagggttgtagattaccccaaaaggaaaaagcagaaactaggacacacacaggtcccagtgtgggatgggggcacctcacgtggatggatctgatagcccttgtcagtcccagggatcagagggagactcagaaaactgtgaggaagataccccaaaatacagggccccctggaacaaggaagccagggaagagtgccctgctgcctagattgaagggctgaagtaattttagggcaacaaagttgatgatagaaagttctctattactgaagaattctagtggttaaaggaactaatgaaataatggatcattaatgtatggtaaaactataacctgaataagcctagtatcactaaaagtggaaaacctgacattgtgtctcctaatgtgatgcaataagaaaacagcaccacttgcaaagtattcctgccttaaaagctgaacctgaatctgatgaaatttctatatttatttttcagtctataaaaaatatgggggtaaagaacaagttaaataactgttagagtgcagtcagctaaatacagaatgtgggactgtcaagagctgtgcaaggcctgggattttgccccacttataaactaacaagttagcctgttttggtttcatggatgctggcaggagacagaagattcctgagtcagagacaaaggattttattgcccacagcaaaagtagtattcagaacttcgtgtttgtttgtgtcagtctccatgccccacaaagcttattggaagtgacacaaagggctcgtgatggatgccttagaatgtagttggttgcattagaggaaagaaacactgagtttggggcattcattgtttttaaggcaagtggaagccagcctgctgtttcggggagatattaccccatccttcaggtttgcttgctgcaaacacaatcttgagaaatggccctggtaaagaatggtcagggctttgcattcttggtatgcctagcaaaaatatatggggatactcaaggccagtgacagattgcctgttggaaaaatacaccccttagcccaatatgttcttgaccaaacttgagtttttacacaagcttgccactccatcagccactctgactaatatgaccagagaggttgggagcaaaaccatttcatttgtctctcctaggagttttatagtttcaggtcttatgttcaggcctttaacacattttgaattaatttttgtacatggtgtaaagtcattttttaaaatttggacgtaatcagttttcccaacatcatttgttgaagagactagtctctcccccattttgtggccttggcaccctcgtcaaatatcatttgacaatatatgtgagggcttatttctgggctaattcttctgttccattggtctgtgtgtctgtctttatgtcagtataatactattttgattactgtagctttgtgatatctttcaaaataggaagtatgagacctccagctttgtttttcttcctaaagatttttttggctatatgggattctttgagactttatatgcatttcagggtttttaaattttttctgcaaaaacaaaaagccattggaattttgatgggaattgcatttaatttatagatcactttgggtagtattgttattttaacaatattaagccttccaatccatgaacatgggatgtctttccatttatttgtatcttcttaaattttttaaagtgatgttttgtagcagtgatacaagaaacaggagggatgaattaatgatattttattattacaagatatactacccatgatgtagtacagtgttatttgaaagtggacttgcattaattataaatgtatactgcaaactctagggcaaccactaaagaaagtaaaaaaagaagtataagtgacatgccaggaaggaagagaacatggaatcatataaagtgctcaattaaaaccacaaaaagcagaaaaacagtggaaaacaaaaacaggaataaaaaacaagggcaacaaatagaaagcagtaacaaatatgatatattaatccaactatatctataatgactgtaaatgttaatgatctaaattttactaagacaaagattgagtagatctaaaaacaagacctaactatatgttgtctacaagaaacacattttatcccaggcacaatggctcacgcctgtaatctcaacactttgggaggccaaggtgggcaggttacaaggtcaggagtttgaaaccagcctggccaacatggtgaaaccccatctctactaaaaatacaaaaattatccaggcgtggtggtgtgcacctgtaatcccagcttttcagaaggctgaggcaggagaattgcatgaacctgggaggcggaggctgcagtgagccaagatcacaccattgcactcccgcctgggtaaaagagcgagactccttctcaaaaaaaaaaaaaaaaaaaaaaaaaaaaaaagggaaagaaagaaacacatttgaaatataagaacatatatagattaaaagtaaatggatgaagaaagatataccatgcctatactaattaagagaaagtggaagtagctatattaattttaggcagagcaaacttcagagcaaggacagatatcagggataaggagggaaattacataatgaaacagcattcaataccccaagaagacataatcattctttttttttttttttttttgagatagagtttttctctgtcacccaggctgaagtacaatggtataatggcacaatctcggctcactgcaacctctgcctccagggttcaagcaattctgtatcagcctcctgagtagctgggattacaggcgcctgccaccacacctggctaattttttgtagtttttagtaaaaattgggtttcaccatgtgggctaggctggtcttgaacttctgacctcaggtgatctgcctgcctcagcctcccaaagtgctgggattacaggcatgagccgctgcaccccgctgacacaataattcttaatgtgtattcacctaacagcagggcatccaaatatgtaagggaaaaactgataaaactgcaagaagacctgggtgaatctactattatagttggagactttaacactcctctaacagaaatggacacagtcagcaggcagaaaaccagtaaggacacagttgaattcaacaacactatcaatcaactgtatataattgacatctacagaatatttcatccagcagcaggcagcagattacaattcttctcaaaatcacatggagcattcaccaagacagatcacattctgggccataaaacacacctcaacaaatataaaagaagtcatatagtgtctgctttcagacctcatgaaattaaactagaaattgatatcagaaagatagctgaaaatcacaaatacctggagattaaacaacatacttctatttttttttttttttttgagacagagtctcaccctgtcacccaggctggagtgcagtggtgcgatcttggctcactgcaagctccacctcctgggttcacgtcattctcctgcctcagcctcctgagtatctgggactacaggcgcccgccaccatgcctggctaatttttttgtattttttagtagagacggggtttcaccgtgttagccaggatggtctcgatctcctgacctcgtgatccacctgtctcagcctcccagattaaacaacatacgtctaagtaatatatgagtgaaagaaaaagtctgatgaagagagttaaaaatatttgaaataaatgaaaatataacttatcaaaatgtctaagatacagcaaaagcagtgcttagaaatttatagtattgaatacatatattagaaaagaagatttaaaatcattaatccagctttcagcttttagctcagagaaggccaaggtgcaactttcttcagttgtcatgaatctgagttcatacaacaccagccatctccaccatgccatcgaagaaaaaagtaaaataaaataattaatccaatattctgccttaggaaactagaaaaagaagagcaaattaaatccaaataagcagaataaaataaatgaaaattatagcagaaatcaatgaaactggaagcagaaaaccaatagagaaaaataacacgaccaaaatctagtttaaaaaaaatcaatatagttgataaacctctagccaggcttactaagaaaaagagaagacacaattactaatatcagaagtgaaagagaagcatcactacagatcccatggacactaaaagaataataaaggaatattattaataactctatgtccacacatttgataacctacttaaagacacaatctgccaaaattaacacaaaaagaaatcaatacttttaataaacctatattgattaaaaaaattggattaataactaataaacttccaaaacagaaatcaccagactcacatggattcattagtgaattctatcaaacatttaaggaagaaattataccaatcctatacaatctgttccagaagacagaagcagaggggatacttcctaaatcattctatgaggctggcattaccctaatattcaaattagacaaagacattacaagagccgggtgcagtggctcacacctgtaatcccacactttgggaggctatggtgggaggatcacttgagttcaggagttcaagaccagcttgggcaacatagcaagacctcatctctactttaaaaaaaaaaaaaaagtagctggtatggtggcacacacctgtagtcccagctactcggaaagctgaagtgggaggatcacttgagcccaggagatcaaccctgcagggagctatgatcatgccactgcactctagtttaggcagcagagtgagtccttgtctcagaaaaaaaaaaatacaagaaaagaaaacaatagagtaatatctctcatgaacatagattcaaaaatcctgaacaaaatactagcaagttgaatccaacaatgtaaagaaagaattacacatcatggtcaagtggaatttatccaaggtaggcaaggctagttcaacatttgaaaatcaattaatgtaatccatcacaacaacaggctaaagaagaaaaatcacatggtcatataaatagatgcagaaaaagcatttgacaaaaaaaaaacatttcatgattggaaaaactcacaataaattgagaatagagatgaacttgctcaacttgatgaagaacatctgccaaaaaacctacagctaacattatacttcatggtgagaaacttgaagattttctcacactatcagggacattgcaaatatgtcccttctcaccactgcttttcaacatcatactggaagtcctagctaatgcaagaacacaagaaaaagaaataaaaggcatatagattgggaaggaagaagtaaaattatctttgtttgcagatgacatgattgtagaaatccaaaagaatcaacaaacaaccctccttgaactaataagcaattatagagggttgtaggatacaaagttaatgtacaaaagccaattgccttctgatacactgtaagcaatgaacaagcagaatttgaaattaaaaacacaataccatttatatccttctgaaaagaaataggtataaatcttaacaaaatatgtggaagatctatataagaaaaactacaaaactctgatgaaaaatatcaaagaagacttaaataaatggagatatagtccatgttcatggataggaagacccagtgttgttgagatgtcagttctgaactggatctatagattcaatgcaatcccaatcaaaatccagtcaagttactttgtggatgttgataaactaattctaaagtttatgtgaagaggcaaagacacagaatagctaactcaacaataaaggagaagagttagaggactgatagtacccaacttactagacttactagaggtcccgcatggtggctcacacctataatcccgactactctaaagtctgaggtgggaggatcacttgagcccaggagttgatgttgataaactgattctaaagtttatgtgaagaggcaaagacatagaatagccaactcaacaataaaggaggagaacagttagaggactgatagtacccaacttactagagttactagaggtcaggcatggtggctcacacctataatcctgactactcaaaaggctgaggtaggaggatcatttgagcccaggagttcaagatcagcctgagcaacatagaaagacctggtttctaacaagttaaaaaaaaaaaaaaaaaaaaaaaaagacttatagaaagctgcagtaatcaagacagtgtgatattcgtgaaatagatcaatgaaacagaacagagagcccagaaaaaaacccacataaacagagccaactaaccttcaacaagggagaaaaggcaatacaatggagcaaagatagtcttttcaacaaatggttctggaacaactggacatccatgtgcaaaaaataaacttaaacatggactttaaacccttcccaaaaattaactcaaaatgaatcacagacctaaatgtaaaatgcaaactataaaactcctataaaataacagagaaaaacttagatgactttgctgatacagtttggatgtgtatccactccagatttcatgttgaaatgtgatccccaatgttggaggtgggacctggtgggaggtatttgggtcatgggggtggatccctcatgaatggcttggtgccctccttgagataatacatgagttctcactctattagttcatgcaaaagctagttttaaaagagcccggcacctcctcccctctctcttgctccctctctcaccatgtgatacactagctccccttttgccttctgccatgattgtaaacttcctgaggtttcaccagaagcagatgctggcactacacttcttgtatagcctatggaactgtgagccaaataaacctgttttctttataaattattcagccttacatattccttcagggcaacacaaaacagactaacatatatgggtatggtgataattttttttttttttgagatggagtctcgctctgttgcccaggctggagtgcagtggtgcaatatcagctcactgcaagctccgcctcctgggttcacgccattctcctgcctcagcctcccgagtagctgggactacaggcgcccgccaccatgcctggctaatttttttttgcatttttagtagagacggggtttcaccgtgttagccaggatggtctcgatctcctgacctcatgatctgcccgccttggcctcccaaagtgctgggattacaggcatgagccactgcgcctggctggtgataactttttagatccaataccaaaattatagttcatgaaagaaacaattgataagctgaacttcaacaaaattaaaacttctgctctgcaaaagacaacgtcaagagaatgagaagagaagccacagactgggagaaaatatttgcaaaagaaccatctgacaaaggactcttatccaaaatacacaaagaaatcttaaaattcaacaataagaaaatgagcagcccaattaaaaaatgggcaaaagacctgaacagacacctaatcaaagaagatatacagatagcaagtaaacatatgaaaagatttaaacatattacatcattagagaattgcaaataaaaacaatgggctatcactacacatgtattagaataactaaaatccaaaacactgacaataccaaataatggcaaggacatggagcaacaggaatattaatccttgctgatgggaatacaaaatggtacagcttcctcagaagacagcagcttcttataaaactaaaaagttataaaacttttaccatacgatccagcaatgcacgccttattatttacccaaataaactgaaaatttgtgtccacacaaacacctgcacatggatgtacatagaagctttattcatagtcgccaaaagttggaagcaaccaagatgtccttcagtaagtgaatgataaataaactgaggtatatctagacaatggaatattatttagcagtaaaaagaaatgagatatcaagccataaaaagacatggaagaaacaaatgcttatcactgagtgaaataagctgatctaaaaggctgcatactgtatgacaccaactatatgacattctggaaaagacacaactatggagacaataaaaagatcagtggttgtcaggggttgggagaaagggaggtatgaataggtgaaacacgggacttttttagggcagtgaaacaatgctgtataatactgcaatggtgaatatgtcattatacatttgtcaaaattcatagaaagtataacaccaagaacgaacactactgtaaagtatggactttgggtgataatgatgtgtaattgtagggccatcagttgtaacaagtgtaccattatggtatgggatgctgatagttggggagattgtgttgtgggggaacagggtatatgggaactctctgtattttctgctcaatttggctataaacctaaaactgatctaaaaactaaaggttattaattaaggaccaaatgagggtcgagtgcggtggctcatgcctgtaatctcaacactttgggaggctgaggtgggtggatcacgaggtcaggagttcgagaccagcctggccaatatggtgaaaccctatctctactaaaaatacaaaaattagctgggcgtggtggcatatgcctgtagtcccagctactcaggaggctgaggcaggagaattgcttgaacccgggaggtggaggttgcagtgagccgagagcacaccattgcactccagcctggcgacagagtgagactccatctcaaaaaaaaaaaacaaaaaaaaaaaacaaagtttataccaggaatttaaaggtggttcaacatctgaaaatcaattgatataattcatcaatagaatagatgaaaagaaaaaagaatgctcttattaggtatagaaaaagcatttgacaaaattcatcatccattcatgattaaaccaatcaaacaacaaactccacaaaaaacttcttggaaactaagaatataaggtcacttccttaatctaagtggcatctacaaaaaaaactactgctaatatcatacttaatggcgaaaggcaagaaaaagaaataaaaggcatacaaattgtaaaggaagaaacaaaatggtctctatttgcagacagcatgattatctatgaagaaattcctaaagaatctacaataaaactgttggattaatacaagtttagcaaggtcacaggatacaaggttaattaaaaagagtcaatcatatattcctgtataacagcaatgaaaaattagaatttgaaatttaaaaggcagcaccatttaaaatagctcaactaacaattaagagcttaggtataaatttaaggcatatgtacagcatccatatgctgaaacctacaaaacattgatgaaataaagaagatctaaataaatgtacagataaagtgtctatatggcttggaaggctcaatatgattaagatgtcattcttccacaaacagcacaatctcaaggaaatctcaggcacatttttagatactgacaaattgattcaaaatttatatggaagctgggcgtggtggcttatacctataatcccagcactttgggaagccaaggtgggcagatcacttgagcccaagagtttgagaccagcctgggcagcaacatagagagagcctgtctctatttaaaaaataaataaataaataaataaataaataaataaataaataaataaataaataaaatggaaaaggtaattaaactacaggagccaattttttttggtttttggtttcttggttttttttgttgttgttgttcgttttttttttttgagacagtctccctctgttgcccagacgggagtgcagtggtgcaatcttggctcactgcaacttccggctcccaggttcaagtgattctcctgcctcagccttccaagtagctgggattacaggcacccaccaccacacttgggtaatttttgtatttttaatagagagggcgtttcaccatgttggccaggctggtctcaaactcctgccctcaagcgatccgcccagcttggcctcccagactgctgggattacaggcatgagccaatacacctggcccaatttttttttttaaataaaacaacaacaaaagaactaagttggaggacccacactactttaaggcttactgtaaagctatagtaatcaagacagcatggtattgttgaaagaatagacacgtatatacattaaacagaataaacggcccaaattaaacttacacaaatatagtcaacagattttttgacaaaagttcaaaggcaattcaatagagaaggaacagttttttcaacaaatggtgctagaatgattcttcatccatatgcaaaaaaggaacctcaacacataattcataccttatacaaaaattatttcaaagtggtttatagacctaaatataaaatataaaactataaaacgtctaggagaaagtgtaagagaccttgagtttgactatgaggtatgtttgtttgtttttttgagatggagtttcgctctagtcactcaggctagagtgcaatggcgtgatctaggctcactgcaacctccgcttcccgggttaaagcgattctcctgcctgagcctcccaagaggctgagattacaggcatgcgccaccaggcccagctaatttttgtattttagtagagacggggtttcaccatgttgcccaggctagtctcgaactcctgacctcaggtgatccaccctccttggcctcccaaagtgctgggattacaggcgtgagccaccatgtccggccaactatgagtatttaaatatgacaccaaaagcacaacccatcaaagaaaaaaatgagaaattgagttttacgaaaattaaagacttttgtgggctgagcatggtggctcatgtctgtaatcccagcactttgggaggctgaggcgggtggatcacgaggtcagtagttcgagaccagcctggccaacatggtgaaacaccatctctactaaaaatacaaaaattagctgggcatggtggcaggcgcctgtaatcctagctacttgggaggctgaagcaggagaatcacttgaacccaggaagcagagtttgcagtgagccaagattgcgccattgcactccagcctgggtgaaagtgcgagactgtgtctcaaaaaaaaaaaaaaaaagacttttgctttgtataaaaatctgtgaagagaatgaaaatacaagccatagacaaggagaaaatatttgcaaatcacatatccaataaagagtttgtatctagaatatataaagaactctttagccataacaataataaaacaaataattaaacttaaaactgtgcaaatgtctgtcttccccaaagaagatgtatggatggcaaataaacatagggaaagatattcaacatcattagtcatgaaggatatgcaaattaaaaccacaatgggataccactatgcacctattacaatggctaaaataaagaactgaatacaaaatattggccttgatgtggagtaacagagtcattcattgctggtggaaatacaaaatggtacagccactttggaaaaacaaatttggcagtttcttataaagttaagcatatacttatgtgacccagcaatctcacttctaggtatttatccaagtgaaatgaaagcttacattcatacaaaaacatgtatatgactagttatacataattttcccaaaatgagcaatcgaaaatgataaattgtgataatccatataatggaatactactcagcaataaaaaggaacagattactgattcatacaaaaacatgggtgaatcttaaaatgcattttcctaagaagatcattattggggctgggtgatgggtacaggaggattgattattctatttttgtgtgtgattgaaaatttccataataaaagttttaaaagtgtattttaatacggtattttttaatgatatcacaatgtccaggtactgcacagatgagactgaagttccacgttctaaagccagaagctgcatctgaaatgttgcatagaaaactgctcattggctgggcgcggtggctcacacctgtaatctcagcactttgggagactgaggcgggcggaccacgaggtcaggagatggagaccatcctggctaacacagtgaaaccccgtctctacttaaaatacaaaaaattagccgggcgtggtggtgggtgcctgtagtcccagctactcgggaggtagaggcaggagaatggtgtgaacccgggaggcggaacttgcagtgagccgagatcacgccacagcactccagcctgggcgacagagtgagactccatctcaaaaaaaaaaaaacaaacaaaaaacttaggtgggcatggtggcaggcacctgtaatcccagctacttgggaggctgaggcacgaaaaatcgcttgaaaccaggaggcagaggttgcagcgagctgaaattgcaccattgcactccagcctgggcgacagagcgagactccatctcaattaaaaacaacaacaacaacaacaaactgctcattacataaagatccaatctggtaatataaattttattttattaagatatatacttagcactttgaattgcttcaaacataatttgaggggaacaaagacttattggcttgttggttttaagaactgaatttgcctaggcattagaaaaagtacagaaagctccccagagcagtctagagcccagcagtcgcaggcccctaggccatttgagttataggacagaaggtgggggtgtcagtgaacactattccttctgagtgtctgtcaatggaggttgcatgtgaaacaggaaagaggtttgctgaggctctatgtttatgtttgccttttcttcaactggagactgaagtttgagaatagcaagtaagcacgtaatcattctcctagatctcattacttgagatcttttttttttttttttttgagacagggtctggctctgttgcccaggctggagtgcaatgggacaatctcagctcactgcaacctctgcctcccaggctcaaaccatcttcccatctaagcctcccaggtagctgggaccacagccgtgtgccaccatggtggggtaatttttgtatttttggtagagacagggtttcgccatgtcacccaggctggtcttgaattcctagcttcaagcaatcctcctgcctcagcctcccagagtaaaggcgtgagccactgtgcttggcctgagataatttcttaagatgatgtataatacctcccgcaatgatagcttccccgatgtaacacctcctgcaagttgtcctgagctattttaagctgtaatcagaatatattgaagattcaacatttttattgtccttgtcctgtacccccagcaataaaaaaaaaaaaaagacttaaaaaaattatggggcctatcggctgggtgtggtggctcatgcctgtaattgcagcactttgggaggctgaggtgggcggatcacctgaggtcgggagttcaagaccagcctgaccaacatggagaaactccatctctactaaaaatacaaaattagccaggtgtggtgagcatgcctgtaatcccagctacttgggaggctgaggcaggagaatcacttgaacccgggaggcggaggttgcagtgagccaagatcaagccattgcactccagcctgggcgacaagagcaaaactccgtctcaaaaaaaaaattatggggccgggcgcggtggctcagtcctataatcctagcactttgggaggtagaggtgggcaggttactggagcccaggagttcaggaccagcctgggcaacattgtgaaaccctgtctctacaaaaaagctactctggaggctgaggcaggaggactgcttgagcccgaggttgaggctgcagtgagccgagattgtgccaccgcactccagcctgggtgacagaacaagactccgtctcaattaaaaaaaaaaaaaaggaaatttctgaagtgatagtaatgttctatgtctcgatagcaatttgggatacaaaggtataggcatttattattattaaaacttggaaatttacacacaagcacataagatttatacatttcattgtatacatattttacttcaaaagaaaaaagtcaacaaatatttaacctagtcaatgatatacatgctgagttatttaggcggaagtctactgatgtctacaatttacttttaaatgcgcccaaaaaaaaaaaaaacagggattgacgaatgcttagagaaaggtacagacatgtgataagccaactatagtgaaatgttagtggtagtctacatggtaggtatatgctgttcactataaaattttttcaactttgctctgtttgcaaattttcacaataatatattggggaaatgtctagaaatgtgatgctaccctaggtcagcaggaactgtgaaagattagacctgtattctggttcccagatgctagagcctttattttttttgggggggtggaggtggagtctcactctgtcgcccagcctggagtgcaatggtgtgatctcggctcactacaacctccacctcccgggttcaagtgattcccctgcctcagcttcccaagtagctggattacaggcaccttccagcatgcccagctaagtttttgtatttttagtagagacggggtttcaccaggtttgtcaggccggtctcaaacttgatccacccgcctcggcctcccaaagtgctgggattacaggcgtgggccaccacgtccagcctgctagagtcttttatacttgatataatttcttgaattc

SEQ ID NO: 72 - DNA, 15 bp, Homo sapiens
gaaagatgataaagt

SEQ ID NO: 73 - DNA, 18 bp, Artificial sequence
  Primer
atgtgggctggagttgtg

SEQ ID NO: 74 - DNA, 19 bp, Artificial sequence
  Primer
caagtgtgtgacatatatc

SEQ ID NO: 75 - DNA, 19 bp, Artificial sequence
  Primer
gctcttaattccctattgc

SEQ ID NO: 76 - DNA, 18 bp, Artificial sequence
  Primer
ctggaggaattctacccc

SEQ ID NO: 77 - DNA, 23 bp, Artificial sequence
  Primer
acccaacgtaatctacaggtgca

SEQ ID NO: 78 - DNA, 21 bp, Artificial sequence
  Primer
gtcaagtcatgtgatttcttc

SEQ ID NO: 79 - DNA, 19 bp, Artificial sequence
  Primer
gcatttctccagggctttg

SEQ ID NO: 80 - DNA, 18 bp, Artificial sequence
  Primer
actgcctgaggaccaaac

SEQ ID NO: 81 - DNA, 17 bp, Artificial sequence
  Primer
cagaggctgggagagag

SEQ ID NO: 82 - DNA, 18 bp, Artificial sequence
  Primer
cgttgggagggaagtcag

SEQ ID NO: 83 - DNA, 19 bp, Artificial sequence
  Primer
ccaagtgtacagggaatag

SEQ ID NO: 84 - DNA, 20 bp, Artificial sequence
  Primer
aatgaaagtagaaaagggcc

SEQ ID NO: 85 - DNA, 21 bp, Artificial sequence
  Primer
gttattttgtcacttgacaag

SEQ ID NO: 86 - DNA, 20 bp, Artificial sequence
  Primer
acatttatcaagacagtctc

SEQ ID NO: 87 - DNA, 19 bp, Artificial sequence
  Primer
ggtcccaactacattttgc

SEQ ID NO: 88 - DNA, 20 bp, Artificial sequence
  Primer
gcttactgtgtaagtaacag

SEQ ID NO: 89 - DNA, 21 bp, Artificial sequence
  Primer
atctctaataactgaatggta

SEQ ID NO: 90 - DNA, 21 bp, Artificial sequence
  Primer
aacatagatgttcttacttag

SEQ ID NO: 91 - DNA, 21 bp, Artificial sequence
  Primer
aataggaataaggatgtgagt

SEQ ID NO: 92 - DNA, 21 bp, Artificial sequence
  Primer
gaaatcttctatcctgaattc

SEQ ID NO: 93 - DNA, 19 bp, Artificial sequence
  Primer
aagcgatactatctgacag

SEQ ID NO: 94 - DNA, 19 bp, Artificial sequence
  Primer
aatctgtacagttcctgag

SEQ ID NO: 95 - DNA, 20 bp, Artificial sequence
  Primer
taaatccccccatatcgcag

SEQ ID NO: 96 - DNA, 19 bp, Artificial sequence
  Primer
tgagagatgcctgtctgtg

SEQ ID NO: 97 - DNA, 21 bp, Artificial sequence
  Primer
cacttcatttcttcatcatag

SEQ ID NO: 98 - DNA, 20 bp, Artificial sequence
  Primer
gcaagcttaatttaaggaga

SEQ ID NO: 99 - DNA, 23 bp, Artificial sequence
  Primer
gttttaaagaaaggtaaacaatt

SEQ ID NO: 100 - DNA, 21 bp, Artificial sequence
  Primer
caaagagaataggtcttgttc

SEQ ID NO: 101 - DNA, 21 bp, Artificial sequence
  Primer
caccaattatatttgttttcc

SEQ ID NO: 102 - DNA, 19 bp, Artificial sequence
  Primer
ggacgatttggaaagtacc

SEQ ID NO: 103 - DNA, 19 bp, Artificial sequence
  Primer
cctttatcataagtgctgc

SEQ ID NO: 104 - DNA, 18 bp, Artificial sequence
  Primer
aagagcttcccgactatg

SEQ ID NO: 105 - DNA, 15 bp, Artificial sequence
  Primer
gagtgagtgccctcc

SEQ ID NO: 106 - DNA, 21 bp, Artificial sequence
  Primer
ggttataaatgtagtaaagaa

SEQ ID NO: 107 - DNA, 21 bp, Artificial sequence
  Primer
ctaagtttccacaattaaaag

SEQ ID NO: 108 - DNA, 21 bp, Artificial sequence
  Primer
gtccctttgtatatctttgag

SEQ ID NO: 109 - DNA, 19 bp, Artificial sequence
  Primer
gcatctcaacaaaggtggc

SEQ ID NO: 110 - DNA, 21 bp, Artificial sequence
  Primer
catgactcttggcttaggaga

SEQ ID NO: 111 - DNA, 19 bp, Artificial sequence
  Primer
tgactcttggcttaggaca

SEQ ID NO: 112 - DNA, 18 bp, Artificial sequence
  Primer
catgtcaacaaaggtggc

SEQ ID NO: 113 - DNA, 19 bp, Artificial sequence
  Primer
cccacttgtaatttggctc

SEQ ID NO: 114 - DNA, 21 bp, Artificial sequence
  Primer
aagacagtagtttatttgaac

SEQ ID NO: 115 - DNA, 20 bp, Artificial sequence
  Primer
ggaacaccataattttggtg

SEQ ID NO: 116 - DNA, 20 bp, Artificial sequence
  Primer
tcttcaagtcaaccctctta

SEQ ID NO: 117 - DNA, 20 bp, Artificial sequence
  Primer
caacttttcacggatacttc

SEQ ID NO: 118 - DNA, 18 bp, Artificial sequence
  Primer
tacggcttttcttgagcc

SEQ ID NO: 119 - DNA, 19 bp, Artificial sequence
  Primer
cccttttacatgttccagc

SEQ ID NO: 120 - DNA, 20 bp, Artificial sequence
  Primer
ttttgttgtgtgtccaggat

SEQ ID NO: 121 - DNA, 18 bp, Artificial sequence
  Primer
ctcaagtccccagatctc

SEQ ID NO: 122 - DNA, 22 bp, Artificial sequence
  Primer
caggtacctgtgggatattaaa

SEQ ID NO: 123 - DNA, 18 bp, Artificial sequence
  Primer
acttctgcttcagatccc

SEQ ID NO: 124 - DNA, 21 bp, Artificial sequence
  Primer
atagtaatcacagaatgggat

SEQ ID NO: 125 - DNA, 20 bp, Artificial sequence
  Primer
caaagctgtcaagcttgtag

SEQ ID NO: 126 - DNA, 21 bp, Artificial sequence
  Primer
gaagggatatcatcatcatga

SEQ ID NO: 127 - DNA, 19 bp, Artificial sequence
  Primer
ggcagggattttgttagtg

SEQ ID NO: 128 - DNA, 22 bp, Artificial sequence
  Primer
agtgtcttacatgcaaatacat

SEQ ID NO: 129 - DNA, 20 bp, Artificial sequence
  Primer
tatgtaggaataaggcaatg

SEQ ID NO: 130 - DNA, 19 bp, Artificial sequence
  Primer
agtttcttcaacaacctgc

SEQ ID NO: 131 - DNA, 18 bp, Artificial sequence
  Primer
tgatcctcaacacagctc

SEQ ID NO: 132 - DNA, 22 bp, Artificial sequence
  Primer
acatttttccagagatattgta

SEQ ID NO: 133 - DNA, 18 bp, Artificial sequence
  Primer
ctcaagtccccagatctc

SEQ ID NO: 134 - DNA, 22 bp, Artificial sequence
  Primer
caggtacctgtgggatattaaa

SEQ ID NO: 135 - DNA, 18 bp, Artificial sequence
  Primer
gaggcgtttgacagtcac

SEQ ID NO: 136 - DNA, 18 bp, Artificial sequence
  Primer
ttagggtgagacataccc

SEQ ID NO: 137 - DNA, 18 bp, Artificial sequence
  Primer
cagagaaagacatgggag

SEQ ID NO: 138 - DNA, 18 bp, Artificial sequence
  Primer
ctactgtttgtgccacag

SEQ ID NO: 139 - DNA, 18 bp, Artificial sequence
  Primer
ggaagactaaagagctgc

SEQ ID NO: 140 - DNA, 21 bp, Artificial sequence
  Primer
tttattcaataaccaagtttc

SEQ ID NO: 141 - DNA, 21 bp, Artificial sequence
  Primer
cttcattataaggtaaagctg

SEQ ID NO: 142 - DNA, 19 bp, Artificial sequence
  Primer
taacacgtttcgaaactgc

SEQ ID NO: 143 - DNA, 24 bp, Artificial sequence
  Primer
gcttttttttgtctttttagatca

SEQ ID NO: 144 - DNA, 23 bp, Artificial sequence
  Primer
gtacacaaattaagttatacaag

SEQ ID NO: 145 - DNA, 21 bp, Artificial sequence
  Primer
gtaaacaatgaaacaaaaacc

SEQ ID NO: 146 - DNA, 17 bp, Artificial sequence
  Primer
gcagcgctagaggtctc

SEQ ID NO: 147 - DNA, 18 bp, Artificial sequence
  Primer
gcaactaactgagtgacc

SEQ ID NO: 148 - DNA, 17 bp, Artificial sequence
  Primer
tccgacctccgctccta

SEQ ID NO: 149 - DNA, 21 bp, Artificial sequence
  Primer
cacatctcataatggtatcac

SEQ ID NO: 150 - DNA, 21 bp, Artificial sequence
  Primer
gaagaagggtatgcttttaga

SEQ ID NO: 151 - DNA, 20 bp, Artificial sequence
  Primer
ttcttggtaaacatctctac

SEQ ID NO: 152 - DNA, 18 bp, Artificial sequence
  Primer
cctgaacaggctgtactc

SEQ ID NO: 153 - DNA, 21 bp, Artificial sequence
  Primer
gataggaaagatttttggtct

SEQ ID NO: 154 - DNA, 19 bp, Artificial sequence
  Primer
ccgttcttagttttgggtc

SEQ ID NO: 155 - DNA, 21 bp, Artificial sequence
  Primer
ctgggctacctgtggatcact

SEQ ID NO: 156 - DNA, 20 bp, Artificial sequence
  Primer
ctgtttacagtagacattcc

SEQ ID NO: 157 - DNA, 18 bp, Artificial sequence
  Primer
ctaggcagcagggcactc

SEQ ID NO: 158 - DNA, 17 bp, Artificial sequence
  Primer
ggcacctcacgtggatg

SEQ ID NO: 159 - DNA, 19 bp, Artificial sequence
  Primer
tcacacctgcaatgaaatc

SEQ ID NO: 160 - DNA, 18 bp, Artificial sequence
  Primer
gttgactctcttcttgcc

SEQ ID NO: 161 - DNA, 19 bp, Artificial sequence
  Primer
attctacttacagcccatg

SEQ ID NO: 162 - DNA, 21 bp, Artificial sequence
  Primer
gtccaatttaaaatttaggcg

SEQ ID NO: 163 - DNA, 18 bp, Artificial sequence
  Primer
taagtgcagcgaacccag

SEQ ID NO: 164 - DNA, 17 bp, Artificial sequence
  Primer
cacttggctgcctggac

SEQ ID NO: 165 - DNA, 19 bp, Artificial sequence
  Primer
acttacatcatcaccagag

SEQ ID NO: 166 - DNA, 22 bp, Artificial sequence
  Primer
atttctccatgattaaaatcag

SEQ ID NO: 167 - DNA, 21 bp, Artificial sequence
  Primer
acatctttttagacacataac

SEQ ID NO: 168 - DNA, 18 bp, Artificial sequence
  Primer
ttggctagcaggcaattg

SEQ ID NO: 169 - DNA, 19 bp, Artificial sequence
  Primer
tcctcaccattagtcaaag

SEQ ID NO: 170 - DNA, 20 bp, Artificial sequence
  Primer
ttaatggtatgatagcaacc

SEQ ID NO: 171 - DNA, 19 bp, Artificial sequence
  Primer
gttttggtggaggaatcgg

SEQ ID NO: 172 - DNA, 18 bp, Artificial sequence
  Primer
gtttctctccctgctttc

SEQ ID NO: 173 - DNA, 18 bp, Artificial sequence
  Primer
gtttggtggaggaatcgg

SEQ ID NO: 174 - DNA, 17 bp, Artificial sequence
  Primer
gtttctctccctgcttc

SEQ ID NO: 175 - DNA, 18 bp, Artificial sequence
  Primer
gactagactggaatctgg

SEQ ID NO: 176 - DNA, 16 bp, Artificial sequence
  Primer
cggtacacaccggtgg

SEQ ID NO: 177 - DNA, 18 bp, Artificial sequence
  Primer
attcccaaatgagcagcc

SEQ ID NO: 178 - DNA, 18 bp, Artificial sequence
  Primer
cataacccctgtgcatcc

SEQ ID NO: 179 - DNA, 19 bp, Artificial sequence
  Primer
gacatctaactgagtctcc

SEQ ID NO: 180 - DNA, 20 bp, Artificial sequence
  Primer
tagtcagtcatatcacatag

SEQ ID NO: 181 - DNA, 19 bp, Artificial sequence
  Primer
cacaaaggcaccaaaccac

SEQ ID NO: 182 - DNA, 20 bp, Artificial sequence
  Primer
acccttacagtccatatgta

SEQ ID NO: 183 - DNA, 110 bp, Homo sapiens
tctaatgcagatagtcctattaacctctcagaggaatagtgaagattaaatgagataaaatatgtaaattgtttagcacagtagctggcaccataaataaaggtaatggt

SEQ ID NO: 184 - DNA, 109 bp, Homo sapiens
atgctgtttttctgtctttaacagaatacatccaagcaatgattctagtgaatgaagcaactataattaacagttcaacatcaataaagggtatgtacatctctattcc

SEQ ID NO: 185 - DNA, 105 bp, Homo sapiens
ctatttagggaaaaagctgatagtgttcatgagccaaactattctaaatgctattacatcttttattacatcatttacacatttatcaagacagtctcttgactt

SEQ ID NO: 186 - DNA, 115 bp, Homo sapiens
acttgctgctttttcattctttctccatccattgcctgccttttagaacaaaatgtgcatgtcttcaactgacagcaaggaatgccaaaacttcccccttgtcaagtgacaaaat

SEQ ID NO: 187 - DNA, 114 bp, Homo sapiens
ttatagggatttgtcccatttttgcatttctgccagcaacatagaagagcgtcagaacagggcttttctgaatgggttcccactattaacaggagctgtgataatttatacatt

SEQ ID NO: 188 - DNA, 122 bp, Homo sapiens
acaaaaaaagaacaaaatcagtgtgatatattaaaaacagaatggttttctaatgcaaaagcacaaggcatcagactttatgctatttctaacctttgtgtttatttttatttaacagcata

SEQ ID NO: 189 - DNA, 115 bp, Homo sapiens
atgagccaaactattctaaatgctattacatcttttattacatcatttacacatttatcaagacagtctcttgacttgacttgctgctttttcattctttctccatccattgcct

SEQ ID NO: 190 - DNA, 113 bp, Homo sapiens
ccttttagaacaaaatgtgcatgtcttcaactgacagcaaggaatgccaaaacttcccccttgtcaagtgacaaaataaccactggatataaatataaaagactacagagaca

SEQ ID NO: 191 - DNA, 133 bp, Homo sapiens
aaagaggaaattagaagttgcatgttcagattgtgaagttgaagttctcccattaggattggaaacacatcctagaactgctaaaactgagaaatgtccaccaaagttcagtaataatcccaaggagcttact

SEQ ID NO: 192 - DNA, 117 bp, Homo sapiens
tgtaagtaacagctgaggaacccagagtaaatctaaattattatcaatcaattggttctttttcattccttcccctctttcttttctcctcatttgtatttatcattttgcttcaaa

SEQ ID NO: 193 - DNA, 128 bp, Homo sapiens
aacgccgcggagccctcggccgcccgagcaggggctggaccccagcccttgcagcctcccttctcctggcacccaagtgcagtcctggctgcagaaggggccgcgggcgcactgagtttccaacctcc

SEQ ID NO: 194 - DNA, 121 bp, Homo sapiens
tttcagcctgtctgtctcagggtgcagccttaatgagaggtgattcctaagctgctgggaacctgaggttgtcaaaggggcggcaggaaatggacagcagtataaaacccagaagcagaac

SEQ ID NO: 195 - DNA, 117 bp, Homo sapiens
gtaataatggatattatctgtacttgagtaaagagaatgaagagaatttttagtgatacagaataacttttttttcctttttagggaaacgaaatatgataatatttcaagaattca

SEQ ID NO: 196 - DNA, 111 bp, Homo sapiens
tatcattcagttattagagatcctgaatccaagacagccatttttcaacacaatgggaaaaaaatggtaaaaaatgcaaaatgtagttgggacccttcttttcttttttaa

SEQ ID NO: 197 - DNA, 100 bp, Homo sapiens
tctcaccagggatattacttataggtgtctttcaggttgcagaaaagatggaaaaaaggacatgtgcactctgccccaaagatgtcgaatataatgtcct

SEQ ID NO: 198 - DNA, 100 bp, Homo sapiens
tactttgcacaatcagagaatatagctgctcatgagaattgtttggtaagttacttgaaaacatacttcaaagtacatgagtacttttagtgtaggacac

SEQ ID NO: 199 - DNA, 100 bp, Homo sapiens
atggtctgctcatccacccccaaagttgccactgttttacccccagtccatttcccactcctggtttgattttccacttttggtatgattttctgacatg

SEQ ID NO: 200 - DNA, 100 bp, Homo sapiens
agctttcaatattactttgtgcatactctggatttttttttccaatctgcagctgtattcttcaggacttgtggaatgtgaggatcaggatccacttaat

SEQ ID NO: 201 - DNA, 80 bp, Homo sapiens
gataaaatgcagggcttctggaacttaaataacatttaatgatatctttgaattttaacaaataacaacaaacaggtact

SEQ ID NO: 202 - DNA, 205 bp, Homo sapiens
agtaaaatctattcttctgtagaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataagg

SEQ ID NO: 203 - DNA, 100 bp, Homo sapiens
aagaacttatccatgtaacctgaaaccacctgttccccaaaaggtattgaaatttaaaaagttacagttttatatgtttaaaaaagcctcttaattcata

SEQ ID NO: 204 - DNA, 100 bp, Homo sapiens
agttattgtaagcagagaaattttcatttttactttttgtaacattttattcattgtttcagctggccaaaaaaaatgaggtatgatgaaattataatta

SEQ ID NO: 205 - DNA, 100 bp, Homo sapiens
ctgacatgtagctttcaatattactttgtgcatactctggatttttttttccaatctgcagctgtattcttcaggacttgtggaatgtgaggatcaggat

SEQ ID NO: 206 - DNA, 100 bp, Homo sapiens
cacttaatcctgatagaagttttgatgtggaatcagtaaagaaagaaatccagagaggaaggaagttggtaagtgtaaatgatgttatttcttatactgg

SEQ ID NO: 207 - DNA, 100 bp, Homo sapiens
aactgtattggaaacctcaattcaacttaacatttaatttttttttttttttttttgagacggagttttgctcttgttgcccaggctagagtgcagtgac

SEQ ID NO: 208 - DNA, 100 bp, Homo sapiens
cggtctcagctcactgcaacctccgcctcctgggttcaagcgattctcctgcctcagcctcccgagtagctaggattacaggcacgggccaccatgctcg

SEQ ID NO: 209 - DNA, 106 bp, Homo sapiens
caaatataagtactgtaccctaatgtttgtaacgggatggaatcttgctgatgatgcccaggataaaatgcagggcttctggaacttaaataacatttaatgatat

SEQ ID NO: 210 - DNA, 138 bp, Homo sapiens
atggaaaaaaggacatgtgcactctgccccaaagatgtcgaatataatgtcctgtactttgcacaatcagagaatatagctgctcatgagaattgtttgctgtattcttcaggacttgtggaatgtgaggatcaggat

SEQ ID NO: 211 - DNA, 118 bp, Homo sapiens
taccctaatgtttgtaacgggatggaatcttgctgatgatgcccaggataaaatgcagggcttctggaacttaaataacatttaatgatatctttgaattttaacaaataacaacaaa

SEQ ID NO: 212 - DNA, 138 bp, Homo sapiens; identical to SEQ ID NO: 210

SEQ ID NO: 213 - DNA, 80 bp, Homo sapiens; identical to SEQ ID NO: 201

SEQ ID NO: 214 - DNA, 209 bp, Homo sapiens
actcagtaaaatctattcttctgtagaaatgcaaattttgtcataaaagaggagccaccgtgggatgtgatttaaaaaactgtaacaagaattaccactttttctgtgccaagaaggacgacgcagttccacagtctgatggagttcgaggaatttataagtatttaataaaacatttttaaaaccacatttgggggattgggataagg

SEQ ID NO: 215 - DNA, 100 bp, Homo sapiens
attgagtgcattcccatatcttttcaccaattatatttgttttcctatgacccaatttgttcatttttctattcaatgaaccctctccccagagagttcc

SEQ ID NO: 216 - DNA, 100 bp, Homo sapiens
catgtgccaatttttctactcaattatttacctgttttgcattaaacttataatatcttttttaaaaattaaccctttatcataagtgctgcaaacactt

SEQ ID NO: 217 - DNA, 100 bp, Homo sapiens
cctttatcataagtgctgcaaacacttagttgaagtttgccatatcttttgactttgtaaaaacttttggcatatgagttgtatatttcatgtagtcaaa

SEQ ID NO: 218 - DNA, 100 bp, Homo sapiens
agtaatcttttcctttatggattccaatttttaaatggtttatatttttagctaaattttcaggagtgaaaagaaaaagaggaaggaagaaacccctctc

SEQ ID NO: 219 - DNA, 222 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagt

SEQ ID NO: 220 - DNA, 394 bp, Homo sapiens
ttgagaaatatttatcacgatattgaaacaatatactgtacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 221 - DNA, 100 bp, Homo sapiens
gtgcactttttgactgtagattgttcgaagacacatttgtaaattttcaagcaggtatatgagttatataacatctgagcagcatagttttgagaaatat

SEQ ID NO: 222 - DNA, 95 bp, Homo sapiens
cacgatattgaaacaatatactgtacaggtgataaaaatattttagaagaatgttcattgttttcttaaatgagaaaagccaattacaaaaacag

SEQ ID NO: 223 - DNA, 240 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatca

SEQ ID NO: 224 - DNA, 376 bp, Homo sapiens
gatattgaaacaatatactgtacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 225 - DNA, 260 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatact

SEQ ID NO: 226 - DNA, 356 bp, Homo sapiens
tacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 227 - DNA, 340 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgacc

SEQ ID NO: 228 - DNA, 276 bp, Homo sapiens
cgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 229 - DNA, 343 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccg

SEQ ID NO: 230 - DNA, 273 bp, Homo sapiens
ccacctgcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 231 - DNA, 349 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacc

SEQ ID NO: 232 - DNA, 267 bp, Homo sapiens
gcccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 233 - DNA, 350 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacct

SEQ ID NO: 234 - DNA, 266 bp, Homo sapiens
cccacacacacaggaaaaaaatatcgaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 235 - DNA, 375 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacctgcccacacacacaggaaaaaaatat

SEQ ID NO: 236 - DNA, 241 bp, Homo sapiens
gaggtacatgtgcacagacaaaagctgcacctggtggagacagtagttggttgtaggtagttggaatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 237 - DNA, 491 bp, Homo sapiens
gttccatggcacatgactgctctctttcctttcccctgttttggattacatatataaatggaggagtttctgcctatacaaactgtttaatattgaaaatgtttctctccctccagactatgaagaaatcgggagtgcactttttgactgtagattgttcgaagacacatttgtaaattttcaagcaggtatatgagttatataacatctgagcagcatagttttgagaaatatttatcacgatattgaaacaatatactgtacaggtgataaaaatattttagaagaatgttcattgttttcttaaatgagaaaagccaattacaaaaacagtatgaccccgcccacctgcccacacacacaggaaaaaaatatcgaggtacatgtgcacagacaaaagctgcacctggtggagacagtagttggttgtaggtagttggaatatagtgatttttgtctgttcttttactgctatattttccagattttct

SEQ ID NO: 238 - DNA, 125 bp, Homo sapiens
tatacacacaaatacttttataatgagaaaaactcattaaaaaagtagagacaacaaaaaattgattcaaaaattggagcatattttggcctgtgtgtggcccaggcaggagctggtaaagcttc

SEQ ID NO: 239 - DNA, 276 bp, Homo sapiens
gaggcacgaggattgtgtatctgtacctgcaagtgaaaggggctagaaatggtacattatttctaataaaactactgaataagctgaaataattttatttcttcttttcatagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattacc

SEQ ID NO: 240 - DNA, 386 bp, Homo sapiens
tttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattcccagcacctagtatgctcagtaaatgtttgtggaataagtgcataaaatgttcttaacctttgattctacttacagcccatgatagcctcttagatataataaatttggattatactactttacttgtaccaaatttgcctgttttcgtgtcacaaagtctgcttttgaaaagtctcttttcagccacagttatcacgtgga

SEQ ID NO: 241 - DNA, 100 bp, Homo sapiens
agtgggcagggagccaagtttctcggtcgcttttccgtcctaggtctctggggtggtaggccgaccctccccacagccaagccatctcggggagcagagc

SEQ ID NO: 242 - DNA, 100 bp, Homo sapiens
ggagcccgtgcctcgcgcgttcctggttcctcagacacaaaagcctctaagtcccggcagcagccaccggatttcatggggacactccagtggcagggcc

SEQ ID NO: 243 - DNA, 100 bp, Homo sapiens
tatttataggaattgcttgaagccagagtcatggtggatgtcggaaagtggcccatcttcactctactctcccctcaagagatcgcgtctattcggaagg

SEQ ID NO: 244 - DNA, 100 bp, Homo sapiens
gtgtgtcttcggcacctcagccagtgaagcactgtacgttactgacaatgatgaggtaagagtctcttgaaacctagtttcgttttaggacttatttggc

SEQ ID NO: 245 - DNA, 100 bp, Homo sapiens
cattgcctgtggtcagacttcatccatggctgttctggacaatggcgaggtgaggtgtctccactcccatttccctttctaccttctttttcaattacac

SEQ ID NO: 246 - DNA, 100 bp, Homo sapiens
tcagtttcttcacaaggtgaatgtatcagatggaagaaggaagagtgctttgttttggtagctccattgaaagttaactgattactgactgaggagctgg

SEQ ID NO: 247 - DNA, 100 bp, Homo sapiens
atatatcccctcatattcttagtcctgaaatgtaaaaagcttcaggtgtattggctttaatttggtgcttaaaaaagatttgaagtaagtatctttaaaa

SEQ ID NO: 248 - DNA, 100 bp, Homo sapiens
tagtattgtgtagttattatggttaatagttttggacctagtttatgaccataggcttttttgttctaatgttactgaaggacttttttttttttaattt

SEQ ID NO: 249 - DNA, 100 bp, Homo sapiens
tatcaagagaggaattactgtggagaatgccttttcgctattctctgctgcagtcagatatgatgcagaggtaacttaaacaacaaacagaaaccagacc

SEQ ID NO: 250 - DNA, 100 bp, Homo sapiens
cctttaactccctttgtgctcgtctcccccgcttcttgcgtgaggcatggaaaacgatgagtcactccacttctgtttagggaatcagtgaacccattga

SEQ ID NO: 251 - DNA, 100 bp, Homo sapiens
gctgacctcgcaggtagcgtgtgggcgcggggtcgagctcgcggaggcctcttccccctcggccctgcccctgcttcccttccccgcaggccgggccggg

SEQ ID NO: 252 - DNA, 100 bp, Homo sapiens
gtgccccgttactcctgtacctcccgcctccctcgctcgggctcccgggcagtccctgcgggcgctgcgtccggggcgagggatggggtccccggcccgg

SEQ ID NO: 253 - DNA, 100 bp, Homo sapiens
gctgattttttgtgtgctttgtgtgcacagatggagtggtttatgcctggggccacaatggatatagccagcttgggaatgggacgaccaaccaaggcat

SEQ ID NO: 254 - DNA, 100 bp, Homo sapiens
gctcccgtccaggtctgtaccaatctcttgatcaagcaagtggtggaagtagcttgtggctcacatcattcaatggctctggcagctgatggagaggtaa

SEQ ID NO: 255 - DNA, 100 bp, Homo sapiens
ttaagagggtagttggcattgcctgtggtcagacttcatccatggctgttctggacaatggcgaggtgaggtgtctccactcccatttccctttctacct

SEQ ID NO: 256 - DNA, 100 bp, Homo sapiens
ctttttcaattacacgtcagtttcttcacaaggtgaatgtatcagatggaagaaggaagagtgctttgttttggtagctccattgaaagttaactgatta

SEQ ID NO: 257 - DNA, 100 bp, Homo sapiens
tctatttcgcctgttaaactgtgaccaaaaactagtacctttcagagtgttctgacatacagtaggtacttaataattgttagtgaggctcaacttcctc

SEQ ID NO: 258 - DNA, 100 bp, Homo sapiens
tgtattaaacaggaaagagtgacttgccccagactatctaactagtaagtcatggagtagaaactgatgccaattctgtcatccccttctccaaaatagc

SEQ ID NO: 259 - DNA, 100 bp, Homo sapiens
tgtctcttccttcttaccagcagtttaaaaatctcactctctcccttctgtcctctctaaggtatatggctggggttacaatggcaacggtcagctgggc

SEQ ID NO: 260 - DNA, 101 bp, Homo sapiens
tgggaaacaatggcaaccagctgacccctgtgagagtggcagctttgcacagcgtgtgtgtgaaccaggtacgtgtggtgcactctcagttagtggcttcc

SEQ ID NO: 261 - DNA, 100 bp, Homo sapiens
tcagggtggtagagattgcagcctgtcactctgcccacacgtctgcagccaagacgcagggtgggcacgtgtacatgtggggccagtgccggggtcagtc

SEQ ID NO: 262 - DNA, 100 bp, Homo sapiens
gtgatcctcccgcacctcacccacttctcctgcaccgacgacgtgtttgcctgctttgccactcccgccgtctcgtggcgcctcctgtctgtgggtaaga

SEQ ID NO: 263 - DNA, 100 bp, Homo sapiens
cgtctgcagccaagacgcagggtgggcacgtgtacatgtggggccagtgccggggtcagtccgtgatcctcccgcacctcacccacttctcctgcaccga

SEQ ID NO: 264 - DNA, 100 bp, Homo sapiens
gacgtgtttgcctgctttgccactcccgccgtctcgtggcgcctcctgtctgtgggtaagaaagtgcagggccacctccacccaggaagaatggtactac

SEQ ID NO: 265 - DNA, 100 bp, Homo sapiens
acgtgtacatgtggggccagtgccggggtcagtccgtgatcctcccgcacctcacccacttctcctgcaccgacgacgtgtttgcctgctttgccactcc

SEQ ID NO: 266 - DNA, 100 bp, Homo sapiens
gccgtctcgtggcgcctcctgtctgtgggtaagaaagtgcagggccacctccacccaggaagaatggtactaccaactgaccagttttcctgtgtctttg

SEQ ID NO: 267 - DNA, 100 bp, Homo sapiens
aagttacacagactgcagcattttggcaaatggatggccctctgctaaaggaattcattgctaaagccagtaaatgtggagcctttaagaactgaagcgc

SEQ ID NO: 268 - DNA, 100 bp, Homo sapiens
aggctgctgggttctgtgtgagtgctctggggcactgttgaggatgtgtccagtttgtgctctacgggtgatgtgattctgcaggtaaaagaccatcagg

SEQ ID NO: 269 - DNA, 100 bp, Homo sapiens
taaacaacccttgtttccagataagtgtattttaaatgtgacctttcgtaaatttgggctggaacatgtaaaagggtgaaagttagtcgtttttggtctt

SEQ ID NO: 270 - DNA, 100 bp, Homo sapiens
ttttcatttttgattagaggaacttctgaacttggaaaggggaagttggcagcaactctcctgggccacgtatcaacaatcttctgacagcaggagcagt

SEQ ID NO: 271 - DNA, 100 bp, Homo sapiens
aaaagggtgaaagttagtcgtttttggtcttcttttcatttttgattagaggaacttctgaacttggaaaggggaagttggcagcaactctcctgggcca

SEQ ID NO: 272 - DNA, 100 bp, Homo sapiens
gtatcaacaatcttctgacagcaggagcagtgatagttggggaattgtgagatgaatggagaggccccatcgtgaattaaagatgctgacctggggattg

SEQ ID NO: 273 - DNA, 100 bp, Homo sapiens
cattaaggtagaacttgagaactcaagtttaaattgtcccccaccaccttcttctataaatgcaaacttaagaggaaaataatgacatgtatagtatact

SEQ ID NO: 274 - DNA, 99 bp, Homo sapiens
ttgccttcctaaattatgactgctgaatcatcatatctactatatatgactggaagaagtggttcttcaagtcaaccctcttacaagacttagtggaat

SEQ ID NO: 275 - DNA, 100 bp, Homo sapiens
tctataaatgcaaacttaagaggaaaataatgacatgtatagtatactcttgccttcctaaattatgactgctgaatcatcatatctactatatatgact

SEQ ID NO: 276 - DNA, 99 bp, Homo sapiens
gaagaagtggttcttcaagtcaaccctcttacaagacttagtggaatttgctttatctactttaggccaaatccatcacacattggcttatgtgaaact

SEQ ID NO: 277 - DNA, 100 bp, Homo sapiens
atgtatagtatactcttgccttcctaaattatgactgctgaatcatcatatctactatatatgactggaagaagtggttcttcaagtcaaccctcttaca

SEQ ID NO: 278 - DNA, 99 bp, Homo sapiens
gacttagtggaatttgctttatctactttaggccaaatccatcacacattggcttatgtgaaactttatcatctttcacttttggttttcctctgtttt

SEQ ID NO: 279 - DNA, 100 bp, Homo sapiens
ctggaagaagtggttcttcaagtcaaccctcttacaagacttagtggaatttgctttatctactttaggccaaatccatcacacattggcttatgtgaaa

SEQ ID NO: 280 - DNA, 15 bp, Homo sapiens
ctttatcatctttca

SEQ ID NO: 281 - DNA, 100 bp, Homo sapiens
ctttatcatctttcacttttggttttcctctgtttttaaacatcttaggtataacagcacaatttcaccttgaaaaagcaccaaaattatggtgttcctg

SEQ ID NO: 282 - DNA, 100 bp, Homo sapiens
gaacctggagcctgaatacattttcagagccaaattacaagtgggtgaagacatgctacaactactatttttagcaatgtttttaaatttgtgtctattg

SEQ ID NO: 283 - DNA, 100 bp, Homo sapiens
ggtgggaaggggagtgaggccctaaagataggaattcactgatagctgaaatagatacaagcctaggagccccagcccccttttcttgaccatatcacaa

SEQ ID NO: 284 - DNA, 100 bp, Homo sapiens
taattataatttcatcatacctcattttttttggccagctgaaacaatgaataaaatgttacaaaaagtaaaaatgaaaatttctctgcttacaataact

SEQ ID NO: 285 - DNA, 100 bp, Homo sapiens
tatgaattaagaggcttttttaaacatataaaactgtaactttttaaatttcaataccttttggggaacaggtggtttcaggttacatggataagttctt

SEQ ID NO: 286 - DNA, 100 bp, Homo sapiens
ttcaactgtgagtttcatcatgtgtgtccgttgagcttgcttttaagagcaatgttttgctttgctctctggtccatgaactcatttccatttgagtgag

SEQ ID NO: 287 - DNA, 100 bp, Homo sapiens
tcccttagtgaattttgtctcctgcttggaaagtctctcttctgaacctggagcctgaatacattttcagagccaaattacaagtgggtgaagacatgct

SEQ ID NO: 288 - DNA, 100 bp, Homo sapiens
gttagaattcgttctacaacatgatagaacttttcttactagcttcagaaatgcacattgatttgtgctatgatgggtggtgtttgtaacaatcactgtt

SEQ ID NO: 289 - DNA, 100 bp, Homo sapiens
tataggcttatgatctgagcaaaatgtgaacttcagtatgtttactattgctcttacttgaaaactttttttcaaaaaaagcacaaattaaagtagtaaa

SEQ ID NO: 290 - DNA, 100 bp, Homo sapiens
tcttactagcttcagaaatgcacattgatttgtgctatgatgggtggtgtttgtaacaatcactgttctataggcttatgatctgagcaaaatgtgaact

SEQ ID NO: 291 - DNA, 100 bp, Homo sapiens
cagtatgtttactattgctcttacttgaaaactttttttcaaaaaaagcacaaattaaagtagtaaattcatatccatagatagttcattcattcaacaa

SEQ ID NO: 292 - DNA, 100 bp, Homo sapiens
aatataagtgaaggaccacttctcatattagattactaagtcatttgtatgaatatgtgtggcagtgaagagaacaggtctttcaaaaagcatttgatta

SEQ ID NO: 293 - DNA, 100 bp, Homo sapiens
tttttttaaatacactctcttatttttctacttgtttttttgttaatcatagcaggatatgacaactcttatttgaattgattttttcatctaatgtaat

SEQ ID NO: 294 - protein, 15 aa, Homo sapiens
AQASPPRPERVLGAC

SEQ ID NO: 295 - protein, 15 aa, Homo sapiens
CEDQDPLNPDRSFDV

SEQ ID NO: 296 - protein, 15 aa, Homo sapiens
KRKRGRKKPLSGNHC

SEQ ID NO: 297 - protein, 15 aa, Homo sapiens
AQASPPRPERVLGAC

SEQ ID NO: 298 - protein, 15 aa, Homo sapiens
CEDQDPLNPDRSFDV

SEQ ID NO: 299 - protein, 15 aa, Homo sapiens
KRKRGRKKPLSGNHC

SEQ ID NO: 300 - protein, 15 aa, Homo sapiens
DITKYREETPPRSRC

SEQ ID NO: 301 - protein, 16 aa, Homo sapiens
QKEQENKSNAFPSTSC

SEQ ID NO: 302 - protein, 15 aa, Homo sapiens
CPPKFSNNPKELTME

SEQ ID NO: 303 - protein, 15 aa, Homo sapiens
CNEIDSRKLPQFKYR

SEQ ID NO: 304 - protein, 16 aa, Homo sapiens
GDNQSTLVPKKLEGLC

SEQ ID NO: 305 - protein, 15 aa, Homo sapiens
GSGSTANQPTPRKVT

SEQ ID NO: 306 - DNA, 21 bp, Artificial sequence
  Oligonucleotide probe
ctctgcctcccgggttcaagc

SEQ ID NO: 307 - DNA, 21 bp, Artificial sequence
  Oligonucleotide probe
gcttgaacccgggaggcagag

SEQ ID NO: 308 - DNA, 21 bp, Artificial sequence
  Oligonucleotide probe
ctctgcctcctgggttcaagc

SEQ ID NO: 309 - DNA, 21 bp, Artificial sequence
  Oligonucleotide probe
gcttgaacccaggaggcagag

SEQ ID NO: 310 - DNA, 21 bp, Artificial sequence
  Oligonucleotide probe
aacggggcactcccggcccgg

SEQ ID NO: 311 - DNA, 21 bp, Artificial sequence
  Oligonucleotide probe
ccgggccgggagtgccccgtt

SEQ ID NO: 312 - DNA, 21 bp, Artificial sequence
  Oligonucleotide probe
aacggggcacacccggcccgg

SEQ ID NO: 313 - DNA, 21 bp, Artificial sequence
  Oligonucleotide probe
ccgggccgggtgtgccccgtt

SEQ ID NO: 314 - DNA, 21 bp, Artificial sequence
  Oligonucleotide probe
aacggggcactcccggcccgg

SEQ ID NO: 315 - DNA, 21 bp, Artificial sequence
  Oligonucleotide probe
ccgggccgggagtgccccgtt

SEQ ID NO: 316 - DNA, 21 bp, Artificial sequence
  Oligonucleotide probe
aacggggcacacccggcccgg

SEQ ID NO: 317 - DNA, 21 bp, Artificial sequence
  Oligonucleotide probe
ccgggccgggtgtgccccgtt

SEQ ID NO: 318 - DNA, 21 bp, Artificial sequence
  Oligonucleotide probe
cacgggctcctgctctgctcc

SEQ ID NO: 319 - DNA, 21 bp, Artificial sequence
  Oligonucleotide probe
ggagcagagcaggagcccgtg

SEQ ID NO: 320 - DNA, 21 bp, Artificial sequence
  Oligonucleotide probe
cacgggctcccgctctgctcc

SEQ ID NO: 321 - DNA, 21 bp, Artificial sequence
  Oligonucleotide probe
ggagcagagcgggagcccgtg

SEQ ID NO: 322 - DNA, 21 bp, Artificial sequence
  Oligonucleotide probe
tccaacctccatttcagcctg

SEQ ID NO: 323 - DNA, 21 bp, Artificial sequence
  Oligonucleotide probe
caggctgaaatggaggttgga

SEQ ID NO: 324 - DNA, 21 bp, Artificial sequence
  Oligonucleotide probe
tccaacctccgtttcagcctg

SEQ ID NO: 325 - DNA, 21 bp, Artificial sequence
  Oligonucleotide probe
caggctgaaacggaggttgga

SEQ ID NO: 326 - DNA, 10 bp, Artificial sequence
  Binding sequence
  misc_feature (5)..(6): n is a or g or c or t
gggrnnyycc

The invention claimed is:

1. A method for identifying a candidate for treating an IgE mediated disease, wherein said method comprises:
   providing a CLLD8 polypeptide having histone methyl transferase activity;
   providing a substrate for said CLLD8 polypeptide;
   providing an agent to be tested; and
   determining whether or not said agent inhibits said histone methyl transferase activity of said CLLD8 polypeptide on said substrate, wherein inhibition of said activity indicates that said agent is said candidate for treating an IgE mediated disease.

2. A method of claim 1, wherein said polypeptide comprises the sequence set forth in SEQ ID NO:69.

3. A method of claim 1, wherein said IgE mediated disease is asthma, atopy, hayfever, eczema, atopic dermatitis, or allergic rhinitis.

4. A method for identifying a candidate for treating an IgE mediated disease, wherein said method comprises:
   providing a CLLD8 polypeptide in the presence of a downstream factor with which it interacts;
   providing an agent to be tested; and
   determining whether or not said agent inhibits the interaction of said CLLD8 polypeptide with said downstream factor, wherein the presence of said inhibited interaction indicates that said agent is said candidate for treating an IgE mediated disease.

5. A method of claim 4, wherein said polypeptide comprises the sequence set forth in SEQ ID NO:69.

6. A method of claim 4, wherein said IgE mediated disease is asthma, atopy, hayfever, eczema, atopic dermatitis, or allergic rhinitis.

7. A method for identifying a candidate for treating an IgE mediated disease, wherein said method comprises:
   providing a cell expressing a CLLD8 polypeptide;
   providing an agent to be tested; and
   determining whether or not said agent inhibits differentiation or proliferation of said cell, wherein the presence of said inhibition indicates that said agent is said candidate for treating an IgE mediated disease.

8. A method of claim 7, wherein said IgE mediated disease is asthma, atopy, hayfever, eczema, atopic dermatitis, or allergic rhinitis.

9. A method for identifying a candidate for treating an IgE mediated disease, wherein said method comprises:
providing a CLLD8 polypeptide comprising a methyl-CpG-binding domain or a SET domain;
providing an agent to be tested; and
determining whether or not said agent inhibits the activity of said methyl-CpG-binding domain or said SET domain of said CLLD8 polypeptide, wherein the activity of said methyl-CpG-binding domain is binding to DNA, wherein the activity of said set domain comprises histone H3 methylation, and wherein the presence of said inhibition indicates that said agent is said candidate for treating an IgE mediated disease.

10. The method of claim 9, wherein said polypeptide comprises the sequence set forth in SEQ ID NO:69.

11. A method of claim 9, wherein said IgE mediated disease is asthma, atopy, hayfever, eczema, atopic dermatitis, or allergic rhinitis.

12. A method of claim 9, wherein said determining step comprises measuring histone methyl transferase activity.

13. A method for identifying a candidate for treating an IgE mediated disease, wherein said method comprises:
providing a polypeptide comprising an amino acid sequence encoded by an exon for a CLLD8 polypeptide and an amino acid sequence encoded by an exon for an ANGE polypeptide, wherein said polypeptide has histone methyl transferase activity;
providing a substrate for said polypeptide;
providing an agent to be tested; and
determining whether or not said agent inhibits said histone methyl transferase activity of said polypeptide on said substrate, wherein inhibition of said activity indicates that said agent is said candidate for treating an IgE mediated disease.

14. A method of claim 13, wherein said IgE mediated disease is asthma, atopy, hayfever, eczema, atopic dermatitis, or allergic rhinitis.

15. A method for identifying a candidate for treating an IgE mediated disease, wherein said method comprises:
providing a polypeptide in the presence of a downstream factor with which it interacts, wherein said polypeptide comprises an amino acid sequence encoded by an exon for a CLLD8 polypeptide and an amino acid sequence encoded by an exon for an ANGE polypeptide;
providing an agent to be tested; and
determining whether or not said agent inhibits the interaction of said polypeptide with said downstream factor, wherein the presence of said inhibited interaction indicates that said agent is said candidate for treating an IgE mediated disease.

16. A method of claim 15, wherein said IgE mediated disease is asthma, atopy, hayfever, eczema, atopic dermatitis, or allergic rhinitis.

17. A method for identifying a candidate for treating an IgE mediated disease, wherein said method comprises:
providing a cell expressing a polypeptide, wherein said polypeptide comprises an amino acid sequence encoded by an exon for a CLLD8 polypeptide and an amino acid sequence encoded by an exon for an ANGE polypeptide;
providing an agent to be tested; and
determining whether or not said agent inhibits differentiation or proliferation of said cell, wherein the presence of said inhibition indicates that said agent is said candidate for treating an IgE mediated disease.

18. A method of claim 17, wherein said IgE mediated disease is asthma, atopy, hayfever, eczema, atopic dermatitis, or allergic rhinitis.

19. A method for identifying a candidate for treating an IgE mediated disease, wherein said method comprises:
providing a polypeptide comprising a methyl-CpG-binding domain, a SET domain, or a PHD domain, wherein said polypeptide comprising an amino acid sequence encoded by an exon for a CLLD8 polypeptide and an amino acid sequence encoded by an exon for an ANGE polypeptide;
providing an agent to be tested; and
determining whether or not said agent inhibits the activity of said methyl-CpG-binding domain, said SET domain, or said PHD domain of said polypeptide, wherein the activity of said methyl-CpG-binding domain is binding to DNA, wherein the activity of said set domain comprises histone H3 methylation, wherein the activity of said PHD domain is chromatin mediated transcriptional regulation, and wherein the presence of said inhibition indicates that said agent is said candidate for treating an IgE mediated disease.

20. The method of claim 19, wherein said polypeptide comprises the amino acid sequence set forth in SEQ ID NO:69 and the amino acid sequence set forth in SEQ ID NO:27.

21. A method of claim 19, wherein said IgE mediated disease is asthma, atopy, hayfever, eczema, a topic dermatitis, or allergic rhinitis.

22. A method of claim 19, wherein said determining step comprises measuring histone methyl transferase activity.

* * * * *